United States Patent
Blaschuk et al.

(10) Patent No.: US 6,358,920 B1
(45) Date of Patent: Mar. 19, 2002

(54) COMPOUNDS AND METHODS FOR MODULATING NONCLASSICAL CADHERIN-MEDIATED FUNCTIONS

(75) Inventors: Orest W. Blaschuk, Westmount; Barbara J. Gour, Montreal, both of (CA)

(73) Assignee: Adherex Technologies, Ottawa (CA)

(*) Notice: Subject to any disclaimer, the term of this patent is extended or adjusted under 35 U.S.C. 154(b) by 0 days.

(21) Appl. No.: 09/187,859

(22) Filed: Nov. 6, 1998

Related U.S. Application Data

(63) Continuation-in-part of application No. 09/073,040, filed on May 5, 1998.

(51) Int. Cl.[7] .................. A61K 38/08; A61K 38/12; A61K 38/16

(52) U.S. Cl. .................. 514/9; 514/11; 514/12; 514/16; 514/17; 530/317; 530/324; 530/328; 530/329

(58) Field of Search .................. 530/324–331, 530/317, 350; 514/9, 11–18

(56) References Cited

U.S. PATENT DOCUMENTS

| | | |
|---|---|---|
| 5,585,351 A | 12/1996 | Ranscht |
| 5,597,725 A | 1/1997 | Suzuki |
| 5,610,281 A | 3/1997 | Brenner et al. |
| 5,639,634 A | 6/1997 | Suzuki |
| 5,643,781 A | 7/1997 | Suzuki |
| 5,646,250 A | 7/1997 | Suzuki |
| 5,663,300 A | 9/1997 | Suzuki |
| 5,708,143 A | 1/1998 | Suzuki |
| 5,811,514 A | 9/1998 | Bard et al. |
| 5,916,771 A | 6/1999 | Hori et al. |

FOREIGN PATENT DOCUMENTS

| | | |
|---|---|---|
| GB | 2 282 379 A | 4/1995 |
| WO | WO 91/04745 | 4/1991 |
| WO | WO 94/11401 | 5/1994 |
| WO | WO 96/27387 | 9/1996 |
| WO | WO 97/38011 | * 10/1997 |
| WO | WO 98/02452 | 1/1998 |
| WO | WO 98/25946 | 6/1998 |

OTHER PUBLICATIONS

Caveda et al., J. Clin. Invest., 98(4):886–893, 1993.*
Huber et al., Genomics, 32:21–28, 1996.*
Getsios et al., "Regulated Expression of Cadherin–6 and Cadherin–11 in the Glandular Epithelial and Stromal Cells of the Human Endometrium," *Developmental Dynamics* 211: 238–247, 1998.
Matsuyoshi and Imamura, "Multiple Cadherins Are Expressed in Human Fibroblasts," *Biochemical And Biophysical Research Communications* 235: 355–358, 1997.
Munro and Blashchuk, In: *Cell Adhesion and Invasion in Cancer Metastasis*, P. Brodt (ed.), RG Landes Co., Austin, Texas, 1996, Chapter 3, "The Structure, Function and Regulation of Cadherins," pp. 17–34.
Okazaki et al., "Molecular Cloning and Characterization of OB–cadherin, a New Member of Cadherin Family Expressed in Osteoblasts," *The Journal of Biological Chemistry* 269(16): 12092–12098, 1994.
Shibata et al., "Identification of Human Cadherin–14, a Novel Neurally Specific Type II Cadherin, by Protein Interaction Cloning," *The Journal Of Biological Chemistry* 272(8): 5236–5240, 1997.
Shibata et al., "Simultaneous expression of cadherin–11 in signet–ring cell carcinoma and stromal cells of diffuse–type gastric cancer," *Cancer Letters* 99: 147–153, 1996.
Shimazui et al., "Complex Cadherin Expression in Renal Cell Carcinoma," *Cancer Research* 56: 3234–3237, 1996.
Simonneau et al., "Cadherin 11 Expression Marks the Mesenchymal Phenotype: Towards New Functions for Cadherins?," *Cell Adhesion and Communication* 3: 115–130, 1995.
Suzuki et al., "Diversity of the cadherin family: evidence for eight new cadherins in nervous tissue," *Cell Regulation* 2: 261–270, 1991.
Tanihara et al., "Cloning of Five Human Cadherins Clarifies Characteristics Features of Cadherin Extracellular Domain and Provides Further Evidence for Two Structurally Different Types of Cadherin," *Cell Adhesion and Communication* 2: 15–26, 1994.
Berndorff et al., "Liver–Intestine Cadherin: Molecular Cloning and Characterization of a Novel $Ca^{2+}$–dependent Cell Adhesion Molecule Expressed in Liver and Intestine," *The Journal of Cell Biology* 125(6): 1353–1369, 1994.
Blaschuk et al., "E–cadherin, estrogens and cancer: is there a connection?," *The Canadian Journal of Oncology* 4(4): 291–301, 1994.
Fredette and Ranscht, "T–Cadherin Expression Delineates Specific Regions of the Developing Motor Axon–Hindlimb Projection Pathway," *The Journal of Neuroscience* 14(12): 7331–7346, 1994.

(List continued on next page.)

Primary Examiner—Marianne P. Allen
(74) Attorney, Agent, or Firm—Seed Intellectual Property Law Group PLLC

(57) ABSTRACT

Modulating agents for inhibiting or enhancing nonclassical cadherin mediated cell adhesion are provided. The modulating agents comprise one or more of: (a) a peptide sequence that is at least 50% identical to a nonclassical cadherin CAR sequence; (b) a non-peptide mimetic of a nonclassical cadherin CAR sequence; (c) a substance, such as an antibody or antigen-binding fragment thereof, that specifically binds a nonclassical cadherin CAR sequence; and/or (d) a polynucleotide encoding a polypeptide that comprises a nonclassical cadherin CAR sequence or analogue thereof. Methods for using such modulating agents for modulating nonclassical cadherin-mediated cell adhesion in a variety of contexts are also provided.

20 Claims, 23 Drawing Sheets

OTHER PUBLICATIONS

Grillner and Matsushima, "The Neural Network Underlying Locomotion in Lamprey—Synaptic and Cellular Mechanisms," *Neuron 7*: 1–15, 1991.

Inoue et al., "Cadherin–6 in the Developing Mouse Brain: Expression Along Restricted Connection Systems and Synaptic Localization Suggest a Potential Role in Neuronal Circuitry," *Developmental Dynamics 211*: 338–351, 1998.

Kawamura et al., "cDNA Cloning and Expression of a Novel Human Desmocollin,"*The Journal of Biological Chemistry 269*(42): 26295–26302, 1994.

King et al., "Cloning of the cDNA (DSC1) Coding for Human Type 1 Desmocollin and Its Assignment to Chromosome 18," *Genomics 18*: 185–194, 1993.

King et al., "The Desmocollins of Human Foreskin Epidermis: Identification and Chromosomal Assignment of a Third Gene and Expression Patterns of the Three Isoforms," *J Invest Dermatol 105*: 314–321, 1995.

Koch et al., "Complete amino acid sequence of the epidermal desmoglein precursor polypeptide and identification of a second type of desmoglein gene," *European Journal of Cell Biology 55*: 200–208, 1991.

Kohmura et al., "Diversity Revealed by a Novel Family of Cadherins Expressed in Neurons at a Synaptic Complex," *Neuron 20*: 1137–1151, 1998.

Munro et al., "Characterization of Cadherins Expressed by Murine Thymocytes," *Cellular Immunology 169*: 309–312, 1996.

Nakagawa and Takeichi, "Neural crest cell–cell adhesion controlled by sequential and subpopulation–specific expression of novel cadherins," *Development 121*: 1321–1332, 1995.

Navarro et al., "Differential Localization of VE– and N–Cadherins in Human Endothelial Cells: VE–Cadherin Competes with N–Cadherin for Junctional Localization," *The Journal of Cell Biology 140*(6): 1475–1484, 1998.

Parker et al., "Desmosomal Glycoproteins II and III. Cadherin–Like Junctional Molecules Generated By Alternative Splicing," *The Journal of Biological Chemistry 266*(16): 10438–10445, 1991.

Ranscht and Bronner–Fraser, "T–cadherin expression alternates with migrating neural crest cells in the trunk of the avian embryo," *Development 111*: 15–22, 1991.

Ranscht and Dours–Zimmermann, "T–Cadherin, a Novel Cadherin Cell Adhesion Molecule in the Nervous System Lacks the Conserved Cytoplasmic Region," *Neuron 7*: 391–402, 1991.

Redies and Takeichi, "Cadherins in the Developing Central Nervous System: An Adhesive Code for Segmental and Functional Subdivisions," *Developmental Biology 180*: 413–423, 1996.

Sacristán et al., "T–Cadherin 2: Molecular Characterization, Function in Cell Adhesion, and Coexpression With T–Cadherin and N–Cadherin," *Journal of Neuroscience Research 34*: 664–680, 1993.

Sano et al., "Protcadherins: a large family of cadherin–related molecules in central nervous system," *The EMBO Journal 12*(6): 2249–2256, 1993.

Shimoyama et al., "Isolation and Sequence Analysis of Human Cadherin–6 Complementary DNA for the Full Coding Sequence and Its Expression in Human Carcinoma Cells," *Cancer Research 55*: 2206–2211, 1995.

Shimoyama et al., "Molecular Cloning and Characterization of a Novel Human Classic Cadherin Homolgous with Mouse Muscle Cadherin," *The Journal of Biological Chemistry 273*:(16): 10011–10018, 1998.

Sugimoto et al., "Molecular Cloning and Characterization of a Newly Identified Member of the Cadherin Family, PB–cadherin," *The Journal Of Biological Chemistry 271*(19): 11548–11556, 1996.

Tkachuk et al., "Identification of an atypical lipoprotein––binding protein from human aortic smooth muscle as T–cadherin," *FEBS Letters 421*: 208–212, 1998.

Vestal and Ranscht, "Glycosyl Phosphatidylinositol–anchored T–Cadherin Mediates Calcium–dependent, Homophilic Cell Adhesion," *The Journal of Cell Biology 119*(2): 451–461, 1992.

Wheeler et al., "Desmosomal glycoprotein DGI, a component of intercellular desmosome junctions, is related to the cadherin family of cell adhesion molecules," *Proc. Natl. Acad. Sci. USA 88*: 4796–4800, 1991.

Bussemakers et al., "The role of OB–cadherin in human prostate cancer," in *Proceedings of the American Association for Cancer Research,* vol. 39, New Orleans, LA, Mar., 1998, p. 500.

Albelda et al., "Adhesion Molecules and Inflammatory Injury," *FASEB J. 8*(8): 504–512, 1994.

Edgington, "How Sweet It Is: Selectin–Mediating Drugs," *Bio/Technology 10*(4): 383–389, 1992.

Kahan, "Immunosuppressive Therapy," *Current Opinion in Immunology 4*(5): 553–560, 1992.

Lutz et al., "Antibody Recognition of Peptide Sequences from the Cell–Cell Adhesion Proteins: N– and E–cadherins," *Peptide Research 9*(5): 233–239, 1996.

Slootstra et al., "Structural Aspects of Antibody–Antigen Interaction Revealed Through Small Random Peptide Libraries," *Molecular Diversity 1*: 87–96, 1995.

Ward and Mulligan, "Blocking of Adhesion Molecules In Vivo as Anti–Inflammatory Therapy," *Therapeutic Immunology 1*: 165–171, 1994.

\* cited by examiner

```
Obcad  EC1  RSKRGWVWNQFFVIEEYTGPDPVLVGRLHSDIDSGD---GNIKYILSGEGAG----TIFVIDDKSGNI-HATKTLDREERAQ----YTLMAQAVDRDT--NRPLEPPSEFIVKVQDINDNPPEF
Obcad  EC2  ----LHETYHANVPERS-NVGTSVIQVTASDADDPTYGNSAKLVYSILEGQP----YFSVEAQTGIRTAL PNMDREAKEE----YHVVIQAKDMGG-HMGGLSGTTKVITLTDVNDNPPKF
Cad5   EC1  RQKRDWIWNQMHIDEEKNTSLPHHVGKIKSSVSRKN-----AKYLLKGEYVG----KVFRVDAETGDV-FAIERLDRENISE----YHLTAVIVDKDTG--ENLETPSSFIKVHDVNDNWPVF
Cad6   EC1  RSKRSMWNQFFLLEEYTGSDYQYVGKLHSDQDRGD---GSLKYILSGDGAG----DLFTINENTGDI-QATKRLDREEKPV----YILRAQAINRRT--GRPVEPESEFIKHDINDNEPIF
Cad6   EC2  ----TKEVYTATVPEMS-DVGTFVVQVTATDADDPTYGNSAKVVYSILQGQP----YFSVESETGIIKTALNMDRENREQ----YQVVIQAKDMGG-QMGGLSGTTVWITLTDVNDNPPRF
Cad6   EC4  ----SKLAYILQIREDA-QINTTIGSVTAQDPDAAR---NPVKYSVDRHTDMD---RIFNIDSGNGSI-FTSKLLDRETLLW----HNITVIATEINN--PKQSSRVPLYIKVLDVNDNAPEF
Cad7   EC1  RTKRSWVWNQFFVLEEYMGSDPLYVGKLHSDVDKGD---GSIKYILSGEGAS----SIFIIDENTGDI-HATKRLDREEQAY----YTLRAQAHDRLT--NKPVEPESEFVKIQDINDNEPKF
Cad7   EC2  ----LDGPYTAGVPEMS-PVGTSVWQVTATDADDPTYGNSARVVYSILQGQP----YFSVEPKTGIIKTALPNMDREAKDQ----YLLVIQAKDMVG-QNGGLSGTTSVTVLTDVNDNPPRF
Cad7   EC4  ----TSRLYSMVVSEAA-KVGTIIGTVAAHDPDASN---SPVRYSIDRNTDLE---RYFNIDANSGVI-TTAKSLDRETNAV----HNITVLAMESQN--PAQIGRGYAITILDINDNAPEF
Cad8   EC1  RSKRGWVWNQMFVLEEFSGPEPILVGRLHTDLDPGS---KKIKYILSGDGAG----TIFQLNDVTGDI-HAIKRLDREEKAE----YTLRAQAVDWET--SKPLEPPSEFIKVQDINDNAPEF
Cad12  EC1  RVKRGWVWNQFFVLEEYVGSEPQYVGKLHSDLDKGE---GTVKYTLSGDGAG----TVFTIDETTGDI-HAIRSLDREEKPF----YTLRAQAVDIET--RKPLEPESEFIKVQDINDNEPKF
Cad12  EC2  ----LDGPYATVPEMS-PVGAYVLQVKATDADDPTYGNSARVVYSILQGQP----YFSIDPKTGVIRTALPNMDREVKEQ----YQVLIQAKDMGG-QLGGLAGTTIWITLIDVNDNPPRF
Cad14  EC1  RPKRGWVWNQFFVLEEHMGPDPQYVGKLHSNSDKGD---GSVKYILTGEGAG----TIFIIDDTTGDI-HSTKSLDREQKTH----YVLHAQAIDRRT--NKPLEPESEFIKVQDINDNAPKF
Cad14  EC2  ----TDGPYIVTVPEMS-DMGTSVLQVTATDADDPTYGNSARVVYSILQGQP----YFSVDPKTGVIRTALHNMDREAREH----YSVVIQAKDMAG-QVGGLSGSTTVNITLTDVNDNPPEL
Cad14  EC4  ----SMPSYLMEVYENA-KIGTVVGTVLAQDPDSTN---SLVRYFINYNVEDD---RFFNIDANTGTIRT-TKVLDREETPW----YNITVTASEIDN--PDLLSHVTGIRVLDVNDNPPEL
Cad15  EC1  ----RVRRAWVIPPISVSENHKRLPYPLVQIKSDKQQ--LGSVIYSIQGPGVDEEPRGVFSIDKFTGKV-FLNAMLDREKTDR---FRLRAFALDLGG--STLEDPTDLEIVWDQNDNRPAF
Cad15  EC2  ----LQEAFTGRVLEGA-VPGTYVTREAATDADDPETDNAAL RFSILQQGSPE---LFSIDELTGEIRTVQVGLDREVVAV---YNLTLQVA-D--MSGDGLTATASAITLDDINDNAPEF
Tcad   EC1  -RQKRSIVVSPILIPENQRQPFPRDVGKVVDSDRPERSKFRLTGKGVDQEPKG--IFRINENTGSV-SVTRTLDREVIAV----YQLFVETTDVNG---KTLEGPVPLEVIVIDQNDNRPIF
PBcad  EC1  RVKRGWVWNQFFVVEEYTGTEPLYVGKIHSDSDEGD---GTIKYTISGEGAG----TIFLIDELTGDI-HATERLDREQKTF----YTLRAQARDRAT--NRLLEPESEFIKVQDINDSEPRF
PBcad  EC2  ----LHGPYIGSVAELS-PTGTSVMQVMASDADDPTYGSSARLVYSVLDGEH-----HFTVDPKTGVIRTAVPDLDRESQER----YEVVIQATDMAG-QLGGLSGSTTVTIVVTDVNDNPPRF
PBcad  EC4  ----RPPSGLLEVQEDA-QVGSLVGVVTARDPDAAN---RPVRYAIDRDSDLE---QIFDIDADTGAI-VTGKGLDRETAGW----HNITVLAMEADN--HAQLSRASLRIRILDVNDNPPEL
LIcad  EC2  ----LQSKYEGSVRQNS-RPGKPFLYVNATDLDDPATPNGQLYYQIVIQLPMINNVMYFQINNKTGAI--SLTREGSQELNPAKNPYNLVISVKDMGGQSENSFSDTTSVDIIVTENIWKAPAP
Pcd43  EC3  ----NQSLYRARVPGGC-TSGTRWQVLATDLDEGP--NGEIIYSFGSHNRAGVR--QLFALDILVTGML-TIKGRLDFEDTKL----HEIYIQAKDKGA----NPEGAHCKVLVEVVDVNDNAPEI
```

```
Human G W V W N Q F F V I E E Y T G P D P V L V G R L H S D I D S G D G N I K Y I L S G E G A G
Mouse G W V W N Q F F V I E E Y T G P D P V L V G R L H S D I D S G D G N I K Y I L S G E G A G Human T I F V I D D K S G N I H A T K T L D R E E R A Q Y T L M A Q A V D R D T N R P L E P P S
Mouse T I F V I D D K S G N I H A T K T L D R E E R A Q Y T L M A Q A V D R D T N R P L E P P S Human E F I V K V Q D I N D N P P E F
Mouse E F I V K V Q D I N D N P P E F
```

*Fig. 3*

N-Ac-CIFVIDDKSGC-NH$_2$

N-Ac-IFVIDDKSG-NH$_2$

N-Ac-CDDKC-NH$_2$

N-Ac-CDDKSC-NH$_2$

N-Ac-CIDDKC-NH$_2$

N-Ac-CIDDKSC-NH$_2$

N-Ac-CIDDKSGC-NH$_2$

N-Ac-CVIDDKSGC-NH$_2$

Control

Control

H-VFRVDAETGD-OH

H-VFRVDAETGD-OH

N-Ac-VFRVDAETGD-NH$_2$

N-Ac-VFRVDAETGD-NH$_2$

N-Ac-<u>CDADC</u>-NH₂

N-Ac-<u>CDAEC</u>-NH₂

N-Ac-<u>CDANC</u>-NH₂

N-Ac-<u>CNRNC</u>-NH₂

N-Ac-<u>CDDTC</u>-NH₂

N-Ac-<u>CDEKC</u>-NH₂

N-Ac-CDELC-NH$_2$

N-Ac-CDENC-NH$_2$

N-Ac-CDETC-NH$_2$

N-Ac-CDKFC-NH$_2$

N-Ac-CDLVC-NH$_2$

N-Ac-CDPKC-NH$_2$

N-Ac-CDPSC-NH₂

N-Ac-CDPVC-NH₂

N-Ac-CDSGC-NH₂

N-Ac-CDSNC-NH₂

N-Ac-CDSSC-NH₂

N-Ac-CDSVC-NH₂

N-Ac-CEAQC-NH₂

N-Ac-CEEFC-NH₂

N-Ac-CEEYC-NH₂

N-Ac-CEKDC-NH₂

N-Ac-CEPKC-NH₂

N-Ac-CERDC-NH₂

N-Ac-CESEC-NH₂

N-Ac-CNDVC-NH₂

N-Ac-CNEKC-NH₂

N-Ac-CNENC-NH₂

N-Ac-CNKDC-NH₂

N-Ac-CNNKC-NH₂

N-Ac-CNQKC-NH₂   N-Ac-CNRDC-NH₂

COMPOUNDS AND METHODS FOR MODULATING NONCLASSICAL CADHERIN-MEDIATED FUNCTIONS

CROSS-REFERENCE TO RELATED APPLICATION

This application is a continuation-in-part of U.S. patent application Ser. No. 09/073,040, filed May 5, 1998.

TECHNICAL FIELD

The present invention relates generally to methods for modulating nonclassical cadherin-mediated functions, and more particularly to the use of modulating agents derived from nonclassical cadherin cell adhesion recognition sequences for inhibiting or enhancing functions mediated by nonclassical cadherins.

BACKGROUND OF THE INVENTION

Cadherins are a rapidly expanding superfamily of calcium-dependent cell adhesion molecules (CAMs) (for review, see Munro et al., In: *Cell Adhesion and Invasion in Cancer Metastasis*, P. Brodt, ed., pp. 17–34, RG Landes Co., Austin Tex., 1996). All cadherins appear to be membrane glycoproteins that generally promote cell adhesion through homophilic interactions (a cadherin on the surface of one cell binds to an identical cadherin on the surface of another cell), although cadherins also appear to be capable of forming heterotypic complexes with one another under certain circumstances and with lower affinity.

There are many different types of cadherins. The most extensively studied group of cadherins is known as the classical, or type I, cadherins. Classical cadherins have been shown to regulate epithelial, endothelial, neural and cancer cell adhesion, with different cadherins expressed on different cell types. All classical cadherins have a similar structure. As illustrated in FIG. 1A, classical cadherins are composed of five extracellular domains (EC1 –EC5), a single hydrophobic domain (TM) that transverses the plasma membrane (PM), and two cytoplasmic domains (CP1 and CP2). The calcium binding motifs DXNDN (SEQ ID NO:1), DXD and LDRE (SEQ ID NO:2) are interspersed throughout the extracellular domains, and each 110 amino acid region that contains such motifs is considered a cadherin repeat. The first extracellular domain (EC1) contains the cell adhesion recognition (CAR) sequence, HAV (His-Ala-Val), along with flanking sequences on either side of the CAR sequence that play a role in conferring specificity. Synthetic peptides containing the HAV sequence and antibodies directed against such peptides have been shown to inhibit classical cadherin-dependent processes (Munro et al., supra; Blaschuk et al., *J. Mol Biol.* 211:679–82, 1990; Blaschuk et al., *Develop. Biol.* 139:227–29, 1990; Alexander et al., *J. Cell. Physiol.* 156:610–18, 1993).

Cadherins that contain calcium binding motifs within extracellular domain cadherin repeats, but do not contain an HAV CAR sequence, are considered to be nonclassical cadherins (illustrated in FIGS. 1B to 1AA). To date, nine groups of nonclassical cadherins have been identified (types II–X). These cadherins are also membrane glycoproteins. Type II, or atypical, cadherins include OB-cadherin (cadherin-11; see Getsios et al., *Developmental Dynamics* 211:238–247, 1998; Simonneau et al., *Cell Adhesion and Communication* 3:115–130, 1995; Okazaki et al.,*J. Biological Chemistry* 269:12092–12098, 1994), cadherin-5 (VE-cadherin; see Navarro et al.,*J. Cell Biology* 140:1475–1484, 1998), cadherin-6 (K-cadherin; see Shimoyama et al., *Cancer Research* 55:2206–2211, 1995; Shimazui et al., *Cancer Research* 56:3234–3237, 1996; Inoue et al., *Developmental Dynamics* 211:338–351, 1998; Getsios et al.,*Developmental Dynamics* 211:238–247, 1998), cadherin-7 (see Nakagawa et al., *Development* 121:1321–1332, 1995), cadherin-8 (see Suzuki et al., *Cell Regulation* 2:261–270, 1991), cadherin-12 (Br-cadherin; see Tanihara et al., *Cell Adhesion and Communication* 2:15–26, 1994), cadherin-14 (see Shibata et al., *J. Biological Chemistry* 272:5236–5240, 1997), cadherin-15 (M-cadherin; see Shimoyama et al.,*J. Biological Chemistry* 273:10011–10018, 1998), and PB-cadherin (see Sugimoto et al., *J. Biological Chemistry* 271:11548–11556, 1996). For a general review of atypical cadherins, see Redies and Takeichi, *Developmental Biology* 180:413–423, 1996 and Suzuki et al., *Cell Regulation* 2:261–270, 1991.

Types III–X include LI-cadherin (type III; see Berndorff et al., *J. Cell Biology* 125:1353–1369, 1994), T-cadherin (type IV; see Ranscht, U.S. Pat. No. 5,585,351; Tkachuk et al., *FEBS Lett.* 421:208–212, 1998; Ranscht et al., *Neuron* 7:391–402, 1991; Sacristan et al.,*J. Neuroscience Research* 34:664–680, 1993; Vestal and Ranscht, *J. Cell Biology* 119:451–461, 1992; Fredette and Ranscht, *J. Neuroscience* 14:7331–7346, 1994; Ranscht and Bronner-Fraser, *Development* 111:15–22, 1991), protocadherins (type V; e.g., protocadherins 42, 43 and 68; see Sano et al., *EMBO J.* 12:2249–2256, 1993; GenBank Accession Number AF029343), desmocollins (type VI; e.g., desmocollins 1, 2, 3 and 4; see King et al., *Genomics* 18:185–194, 1993; Parker et al.,*J. Biol. Chem.* 266:10438–10445, 1991; King et al.,*J. Invest. Dermatol.* 105:314–321, 1995; Kawamura et al., *J. Biol. Chem.* 269:26295–26302, 1994), desmogleins (type VII; e.g., desmogleins 1 and 2; see Wheeler et al.,*Proc. Natl. Acad. Sci. USA* 88:4796–4800; Koch et al.,*Eur. J. Cell. Biol.* 55:200–208, 1991), and cadherin-related neuronal receptors (type X; see Kohmura et al., *Neuron* 20:1137–1151, 1998).

Most studies of nonclassical cadherins have focused on atypical or type II cadherins. The structure of these cadherins is similar to that of the type I cadherins, but they do not contain the CAR sequence, HAV (FIG. 1B). Furthermore, functions mediated by the atypical cadherins may be diverse. OB-cadherin, which is also known as cadherin-11, is an atypical cadherin (Getsios et al., *Developmental Dynamics* 211:238–247, 1998; Okazaki et al., *J. Biol. Chem.* 269:12092–98, 1994; Suzuki et al., *Cell Regulation* 2:261–70, 1991; Munro et al., supra). This cadherin can promote cell adhesion through homophilic interactions. Recent studies have shown that OB-cadherin is not expressed by well-differentiated, poorly invasive cancer cells, whereas it is expressed by invasive cancer cells (et al., *Cancer Res.* 56:3234–37, 1996; Shibata et al., *Cancer Letters* 99:147–53, 1996). OB-cadherin levels are also high in stromal cells and osteoblasts (Shibata et al., *Cancer Letters* 99:147–53, 1996; Simonneau et al., *Cell Adhes. Commun.* 3:115–30, 1995; Matsuyoshi and Imamura, *Biochem. Biophys. Res. Commun.* 23:355–58, 1997; Okazaki et al.,*J. Biol. Chem.* 269:12092–98, 1994). Collectively, these observations have led to the hypothesis that OB-cadherin may mediate the interaction between malignant tumor cells and other cell types, such as stromal cells and osteoblasts, thus facilitating tumor cell invasion and metastasis.

OB-cadherin is expressed in certain specific cell types. In some invasive cancer cells, OB-cadherin is not only found at sites of cell-cell contact, but also in lamellopodia-like projections which do not interact with other cells. These observations suggest that OB-cadherin may also play a role in modulating cell-substrate interactions. In adipocytes, OB-cadherin is the only known expressed cadherin. OB-cadherin is therefore likely to mediate adhesion between adipocytes, and it is likely to be an important regulator of adipogenesis. Another cell type that expresses OB-cadherin is the pericyte (also known as the peri-endothelial cell). Pericytes are contractile cells which are similar to smooth muscle cells. They encircle the endothelial cells of blood vessels. Pericytes are involved in maintaining the structural integrity of blood vessels (Hanahan, Science 277:48–50, 1997; Lindahl et al., Science 277:242–245, 1997). Loss of pericytes causes blood vessels to regress.

Other atypical cadherins appear to have different functions. For example, cadherin-5 (also referred to as VE-cadherin) appears to be involved in endothelial cell adhesion and cadherin-6 (also referred to as K-cadherin) may be involved in embryonic kidney cell adhesion and is up-regulated in kidney cancer. Cadherin-15 also appears to play a role in the terminal differentiation of muscle cells.

Notwithstanding these recent advances, nonclassical cadherin function remains poorly understood at the biological and molecular levels. Accordingly, there is a need in the art for identifying sequences involved in modulating nonclassical cadherin-dependent functions, such as cell adhesion, and for the development of methods employing such sequences to inhibit processes such as cancer cell adhesion, invasion and metastasis. The present invention fulfills these needs and further provides other related advantages.

SUMMARY OF THE INVENTION

Briefly stated, this invention provides compositions and methods for modulating nonclassical cadherin-mediated functions, such as cancer cell adhesion, invasion, and metastasis. Within certain aspects, modulating agents capable of modulating (i.e., inhibiting or enhancing) one or more functions mediated by a nonclassical cadherin are provided. Such modulating agents generally: (a) comprise a peptide sequence that is at least 50% identical to a nonclassical cadherin CAR sequence; (b) modulate a function mediated by the nonclassical cadherin, such that the modulating agent: (i) detectably inhibits a function that is modulated by the nonclassical cadherin; or (ii) detectably enhances adhesion of cells that express the nonclassical cadherin; and (c) contain no more than 85, and preferably no more than 50, consecutive amino acid residues present within the nonclassical cadherin. Certain modulating agents comprise a nonclassical cadherin CAR sequence and are 3–16 amino acid residues in length.

For certain modulating agents as provided above, the nonclassical cadherin CAR sequence has the formula:

Aaa-Phe-Baa-Ile/Leu/Val-Asp/Asn/Glu-Caa-
Daa-Ser/Thr/Asn-Gly (SEQ ID NO:3)

wherein Aaa, Baa, Caa and Daa are independently selected amino acid residues; Ile/Leu/Val is an amino acid that is selected from the group consisting of isoleucine, leucine and valine, Asp/Asn/Glu is an amino acid that is selected from the group consisting of aspartate, asparagine and glutamate; and Ser/Thr/Asn is an amino acid that is selected from the group consisting of serine, threonine or asparagine. For other modulating agents as described above, the nonclassical cadherin CAR sequence consists of at least three consecutive amino acid residues, and preferably at least five consecutive amino acid residues, of a nonclassical cadherin, wherein the consecutive amino acids are present within a region of the nonclassical cadherin having the formula recited above. Other modulating agents may comprise at least nine consecutive amino acid residues of a nonclassical cadherin, wherein the nine consecutive amino acid residues comprise a region having a formula as recited above.

Within certain specific embodiments, a modulating agent as described above is a peptide ranging in size from 3 to 50, preferably from 4 to 16, amino acid residues.

Within other embodiments, a modulating agent comprises a nonclassical cadherin CAR sequence that is present within a cyclic peptide. Such cyclic peptides may have the formula:

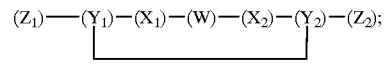

wherein W is a tripeptide selected from the group consisting of EEY, DDK, EAQ, DAE, NEN, ESE, DSG, DEN, EPK, DAN, EEF, NDV, DET, DPK, DDT, DAN, DKF, DEL, DAD, NNK, DLV, NRD, DPS, NQK, NRN, NKD, EKD, ERD, DPV, DSV, DLY, DSN, DSS, DEK and NEK; wherein $X_1$, and $X_2$ are optional, and if present, are independently selected from the group consisting of amino acid residues and combinations thereof in which the residues are linked by peptide bonds, and wherein $X_1$ and $X_2$ independently range in size from 0 to 10 residues, such that the sum of residues contained within $X_1$ and $X_2$ ranges from 1 to 12; wherein $Y_1$ and $Y_2$ are independently selected from the group consisting of amino acid residues, and wherein a covalent bond is formed between residues $Y_1$ and $Y_2$; and wherein $Z_1$ and $Z_2$ are optional, and if present, are independently selected from the group consisting of amino acid residues and combinations thereof in which the residues are linked by peptide bonds.

Within other aspects of the present invention, polynucleotides encoding a modulating agent as described above are provided, along with expression vectors comprising such a polynucleotide and host cells transformed or transfected with such an expression vector.

The present invention further provides modulating agents that comprise an antibody or antigen-binding fragment thereof that specifically binds to a nonclassical cadherin CAR sequence and modulates a nonclassical cadherin-mediated function, wherein the nonclassical cadherin CAR sequence has the formula:

Aaa-Phe-Baa-Ile/Leu/Val-Asp/Asn/Glu-Caa-Daa-
Ser/Thr/Asn-Gly (SEQ ID NO:3)

wherein Aaa, Baa, Caa and Daa are independently selected amino acid residues; Ile/Leu/Val is an amino acid that is selected from the group consisting of isoleucine, leucine and valine, Asp/Asn/Glu is an amino acid that is selected from the group consisting of aspartate, asparagine and glutamate; and Ser/Thr/Asn is an amino acid that is selected from the group consisting of serine, threonine and asparagine; and wherein the modulating agent inhibits or enhances a function mediated by the nonclassical cadherin. Within specific embodiments, the nonclassical cadherin CAR sequence may be any of the sequences recited below.

Within further aspects, the present invention provides modulating agents comprising a non-peptide mimetic of any one of the nonclassical cadherin CAR sequences provided above.

Within certain specific embodiments, a modulating agent as provided herein may comprise: (a) one or more OB-cadherin CAR sequences selected from the group consisting of DDK, IDDK (SEQ ID NO:4051) DDKS (SEQ ID NO:73), VIDDK (SEQ ID NO:74), IDDKS (SEQ ID NO:75), VIDDKS (SEQ ID NO:76), DDKSC (SEQ ID NO:77), IDDKSG (SEQ ID NO:78), VIDDKSG (SEQ ID NO:79), FVIDDK (SEQ ID NO:80), FVIDDKS (SEQ ID NO:81), FVIDDKSG (SEQ ID NO:82), IFVIDDK (SEQ ID NO:83), IFVIDDKS (SEQ ID NO:84), IFVIDDKSG (SEQ ID NO:85). EEY, IEEY (SEQ ID NO:86), EEYT (SEQ ID NO:87), VIEEY (SEQ ID NO:88), IEEYT (SEQ ID NO:89), VIEEYT (SEQ ID NO:90), EEYTG (SEQ ID NO:91), IEEYTG (SEQ ID NO:92), VIEEYTG (SEQ ID NO:93), FVIEEY (SEQ ID NO:94), FVIEEYT (SEQ ID NO:95), FVIEEYTG (SEQ ID NO:96), FFVIEEY (SEQ ID NO:97), FFVIEEYT (SEQ ID NO:98), FFVIEEYTG (SEQ ID NO:99), EAQ, VEAQ (SEQ ID NO:100), EAQT (SEQ ID NO:101), SVEAQ (SEQ ID NO:102), VEAQT (SEQ ID NO:103), SVEAQT (SEQ ID NO:104), EAQTG (SEQ ID NO:105), VEAQTG (SEQ ID NO:106), SVEAQTG (SEQ ID NO:107), FSVEAQ (SEQ ID NO:108), FSVEAQT (SEQ ID NO:109), FSVEAQTG (SEQ ID NO:110), YFSVEAQ (SEQ ID NO:111), YFSVEAQT (SEQ ID NO:112) and YFSVEAQTG (SEQ ID NO:113); or (b) an analogue of any of the foregoing sequences that differs in one or more substitutions, deletions, additions and/or insertions such that that ability of the analogue to modulate an OB-cadherin-mediated function is not substantially diminished. For example, the agent may comprise a linear peptide having the sequence N-Ac-IFVIDDKSG-$NH_2$ (SEQ ID NO:85), N-Ac-FFVIEEYTG-$NH_2$ (SEQ ID NO:99) or N-Ac-YFSVEAQTG-$NH_2$ (SEQ ID NO:113). The OB-cadherin CAR sequence may, but need not, be present within a cyclic peptide.

Within certain specific embodiments, a modulating agent as provided herein may comprise: (a) one or more cadherin-5 CAR sequences selected from the group consisting of DAE, VDAE (SEQ ID NO:114), DAET (SEQ ID NO:115), RVDAE (SEQ ID NO:116), VDAET (SEQ ID NO:117), RVDAET (SEQ ID NO:118), DAETG (SEQ ID NO:119), VDAETG (SEQ ID NO:120), RVDAETG (SEQ ID NO:121), FRVDAE (SEQ ID NO:122), FRVDAET (SEQ ID NO:123), FRVDAETG (SEQ ID NO:124), VFRVDAE (SEQ ID NO:125), VFRVDAET (SEQ ID NO:126) and VFRVDAETG (SEQ ID NO:127); or (b) an analogue of any of the foregoing sequences that differs in one or more substitutions, deletions, additions and/or insertions such that that ability of the analogue to modulate a cadherin-5-mediated function is not substantially diminished. For example, the agent may comprise a linear peptide having the sequence N-Ac-VFRVDAETG-$NH_2$ (SEQ ID NO:127). The cadherin-5 CAR sequence may, but need not, be present within a cyclic peptide.

Within certain specific embodiments, a modulating agent as provided herein may comprise: (a) one or more cadherin-6 CAR sequences selected from the group consisting of NEN, INEN (SEQ ID NO128), NENT (SEQ ID NO:129), IINEN (SEQ ID NO:130), INENT (SEQ ID NO:131), IINENT (SEQ ID NO:132), NENTG (SEQ ID NO:133), INENTG (SEQ ID NO:134), IINENTG (SEQ ID NO:135), FIINEN (SEQ ID NO:136), FIINENT (SEQ ID NO:137), FIINENTG (SEQ ID NO:138), LFIINEN (SEQ ID NO:139), LFIINENT (SEQ ID NO:140), LFIINENTG (SEQ ID NO:141), EEY, EEYT (SEQ ID NO:142), EEYTG (SEQ ID NO:143), LEEY (SEQ ID NO:144), LEEYT (SEQ ID NO:145), LEEYTG (SEQ ID NO:146), LLEEY (SEQ ID NO:147), LLEEYTG (SEQ ID NO:148), FLLEEY (SEQ ID NO:149), FLLEEYT (SEQ ID NO:150), FLLEEYTG (SEQ ID NO:151), FFLLEEY (SEQ ID NO:152), FFLLEEYT (SEQ ID NO:153), FFLLEEYTG (SEQ ID NO:154), ESE, ESET (SEQ ID NO:155), ESETG (SEQ ID NO:156), VESE (SEQ ID NO:157), VSEST (SEQ ID NO:158), VESETG (SEQ ID NO:159), SVESE (SEQ ID NO:160), SVESET (SEQ ID NO:161), SVESETG (SEQ ID NO:162), FSVESE (SEQ ID NO:163), FSVESET (SEQ ID NO:164), FSVESETG (SEQ ID NO:165), YFSVESE (SEQ ID NO:166), YFSVESET (SEQ ID NO:167), YFSVESETG (SEQ ID NO:168), DSG, DSGN (SEQ ID NO:169), DSGNG (SEQ ID NO:170), IDSG (SEQ ID NO:171), IDSGN (SEQ ID NO:172), IDSGNG (SEQ ID NO:173), NIDSG (SEQ ID NO:174), NIDSGN (SEQ ID NO:175), NIDSGNG (SEQ ID NO:176), FNIDSG (SEQ ID NO:177), FNIDSGN (SEQ ID NO:178), FNIDSGNG (SEQ ID NO:179), IFNIDSG (SEQ ID NO:180), IFNIDSGN (SEQ ID NO:181) and IFNIDSGNG (SEQ ID NO:182); or (b) an analogue of any of the foregoing sequences that differs in one or more substitutions, deletions, additions and/or insertions such that that ability of the analogue to modulate a cadherin-6-mediated function is not substantially diminished. For example, the agent may comprise a linear peptide having the sequence N-Ac-FFLLEEYTG-$NH_2$ (SEQ ID NO:154), N-Ac-LFIINENTG-$NH_2$ (SEQ ID NO:141),N-Ac-YFSVESETG-$NH_2$ (SEQ ID NO:168) or N-Ac-IFNIDSGNG-$NH_2$ (SEQ ID NO:187). The cadherin-6 CAR sequence may, but need not, be present within a cyclic peptide.

Within certain specific embodiments, a modulating agent as provided herein may comprise: (a) one or more cadherin-7 CAR sequences selected from the group consisting of DEN, IDEN (SEQ ID NO:183), DENT (SEQ ID NO:184), IIDEN (SEQ ID NO:185), IDENT (SEQ ID NO:186), IIDENT (SEQ ID NO:187), DENTG (SEQ ID NO:188), IDENTG (SEQ ID NO:189), IIDENTG (SEQ ID NO:190), FIIDEN (SEQ ID NO:191), FIIDENT (SEQ ID NO:192), FIIDENTG (SEQ ID NO:193), IFIIDEN (SEQ ID NO:194), IFIIDENT (SEQ ID NO:195), IFIIDENTG (SEQ ID NO:196), EPK, EPKT (SEQ ID NO:197), EPKTG (SEQ ID NO:198), VEPK (SEQ ID NO:199), VEPKT (SEQ ID NO:200), VEPKTG (SEQ ID NO:201), SVEPK (SEQ ID NO:202), SVEPKT (SEQ ID NO:203), SVEPKTG (SEQ ID NO:204), FSVEPK (SEQ ID NO:205), FSVEPKT (SEQ ID NO:206), FSVEPKTG (SEQ ID NO:207), YFSVEPK (SEQ ID NO:208), YFSVEPKT (SEQ ID NO:209), YFSVEPKTG (SEQ ID NO:210), DAN, DANS (SEQ ID NO:211), DANSG (SEQ ID NO:212), IDAN (SEQ ID NO:213), IDANS (SEQ ID NO:214), IDANSG (SEQ ID NO:215), NIDAN (SEQ ID NO:216), NIDANS (SEQ ID NO:217), NIDANSG (SEQ ID NO:218), FNIDAN (SEQ ID NO:219), FNIDANS (SEQ ID NO:220), FNIDANSG (SEQ ID NO:221), YFNIDAN (SEQ ID NO:222), YFNIDANS (SEQ ID NO:223) and YFNIDANSG (SEQ ID NO:224); or (b) an analogue of any of the foregoing sequences that differs in one or more substitutions, deletions, additions and/or insertions such that that ability of the analogue to modulate a cadherin-7-mediated function is not substantially diminished. For example, the agent may comprise a linear peptide having the sequence N-Ac-IFIIDENTG-$NH_2$ (SEQ ID NO:196), N-Ac-YFSVEPKTG-$NH_2$ (SEQ ID NO:210) or N-Ac-YFNIDANSG-$NH_2$ (SEQ ID NO:224). The cadherin-7 CAR sequence may, but need not, be present within a cyclic peptide.

Within certain specific embodiments, a modulating agent as provided herein may comprise: (a) one or more cadherin-8 CAR sequences selected from the group consisting of NDV, INDV (SEQ ID NO:225), NDVT (SEQ ID NO:226), QINDV (SEQ ID NO:227), INDVT (SEQ ID NO:228), QINDVT (SEQ ID NO:229), NDVTG (SEQ ID NO:230), INDVTG (SEQ ID NO:231), QINDVTG (SEQ ID NO:232), FQINDV (SEQ ID NO:233), FQINDVT (SEQ ID NO:234), FQINDVTG (SEQ ID NO:235), IFQINDV (SEQ ID NO:236), IFQINDVT (SEQ ID NO:237), IFQINDVTG (SEQ ID NO:238), EEF, EEFS (SEQ ID NO:239), EEFSG (SEQ ID NO:240), LEEF (SEQ ID NO:241), LEEFS (SEQ ID NO:242), LEEFSG (SEQ ID NO:243), VLEEF (SEQ ID NO:244), VLEEFS (SEQ ID NO:245), VLEEFSG (SEQ ID NO:247), FVLEEF (SEQ ID NO:247), FVLEEFS (SEQ ID NO:248), FVLEEFSG (SEQ ID NO:249), MFVLEEF (SEQ ID NO:250), MFVLEEFS (SEQ ID NO:251) and MFVLEEFSG (SEQ ID NO:252); or (b) an analogue of any of the foregoing sequences that differs in one or more substitutions, deletions, additions and/or insertions such that that ability of the analogue to modulate a cadherin-8-mediated function is not substantially diminished. For example, the agent may comprise a linear peptide having the sequence N-Ac-MFVLEEFSG-NH$_2$ (SEQ ID NO:252) or N-Ac-IFQINDVTG-NH$_2$ (SEQ ID NO:238). The cadherin-8 CAR sequence may, but need not, be present within a cyclic peptide.

Within certain specific embodiments, a modulating agent as provided herein may comprise: (a) one or more cadherin-12 CAR sequences selected from the group consisting of DET, IDET (SEQ ID NO:253), DETT (SEQ ID NO:254), TIDET (SEQ ID NO:255), IDETT (SEQ ID NO:256), TIDETT (SEQ ID NO:257), DETTG (SEQ ID NO:258), IDETTG (SEQ ID NO:259), TIDETTG (SEQ ID NO:260), FTIDET (SEQ ID NO:261), FTIDETT (SEQ ID NO:262), FTIDETTG (SEQ ID NO:263), VFTIDET (SEQ ID NO:264), VFTIDETT (SEQ ID NO:265), VFTIDETTG (SEQ ID NO:266), DPK, DPKT (SEQ ID NO:267), DPKTG (SEQ ID NO:268), IDPK (SEQ ID NO:269), IDPKT (SEQ ID NO:270), IDPKTG (SEQ ID NO:271), SIDPK (SEQ ID NO:272), SIDPKT (SEQ ID NO:273), SIDPKTG (SEQ ID NO:274), FSIDPK (SEQ ID NO:275), FSIDPKT (SEQ ID NO:276), FSIDPKTG (SEQ ID NO:277), YFSIDPK (SEQ ID NO:278), YFSIDPKT (SEQ ID NO:279) and YFSIDPKTG (SEQ ID NO:280); or (b) an analogue of any of the foregoing sequences that differs in one or more substitutions, deletions, additions and/or insertions such that that ability of the analogue to modulate a cadherin-12-mediated function is not substantially diminished. For example, the agent may comprise a linear peptide having the sequence N-Ac-VFTIDETTG-NH$_2$ (SEQ ID NO:266) or N-Ac-YFSIDPKTG-NH$_2$ (SEQ ID NO:280). The cadherin-12 CAR sequence may, but need not, be present within a cyclic peptide.

Within certain specific embodiments, a modulating agent as provided herein may comprise: (a) one or more cadherin-14 CAR sequences selected from the group consisting of DDT, IDDT (SEQ ID NO:281), DDTT (SEQ ID NO:282), IIDDT (SEQ ID NO:283), IDDTT (SEQ ID NO:284), IIDDTT (SEQ ID NO:285), DDTTG (SEQ ID NO:286), IDDTTG (SEQ ID NO:287), IIDDTTG (SEQ ID NO:288), FIIDDT (SEQ ID NO:289), FIIDDTT (SEQ ID NO:290), FIIDDTTG (SEQ ID NO:291), IFIIDDT (SEQ ID NO:292), IFIIDDTT (SEQ ID NO:293), IFIIDDTTG (SEQ ID NO:294), DPK, DPKT (SEQ ID NO:295), DPKTG (SEQ ID NO:296), VDPK (SEQ ID NO:297), VDPKT (SEQ ID NO:298), VDPKTG (SEQ ID NO:299), SVDPK (SEQ ID NO:300), SVDPKT (SEQ ID NO:301), SVDPKTG (SEQ ID NO:302), FSVDPK (SEQ ID NO:303), FSVDPKT (SEQ ID NO:304), FSVDPKTG (SEQ ID NO:305), YFSVDPK (SEQ ID NO:306), YFSVDPKT (SEQ ID NO:307), YFSVDPKTG (SEQ ID NO:308), DAN, DANT (SEQ ID NO:309), DANTG (SEQ ID NO:310), IDANT (SEQ ID NO:311), IDANTG (SEQ ID NO:312), NIDANT (SEQ ID NO:313), NIDANTG (SEQ ID NO:314), FNIDANT (SEQ ID NO:315), FNIDANTG (SEQ ID NO:316), FFNIDAN (SEQ ID NO:317), FFNIDANT (SEQ ID NO:318) and FFNIDANTG (SEQ ID NO:319); or (b) an analogue of any of the foregoing sequences that differs in one or more substitutions, deletions, additions and/or insertions such that that ability of the analogue to modulate a cadherin-14-mediated function is not substantially diminished. For example, the agent may comprise a linear peptide having the sequence N-Ac-IFIIDDTTG-NH$_2$ (SEQ ID NO:294), N-Ac-YFSVDPKTG-NH$_2$ (SEQ ID NO:308) or N-Ac-FFNIDANTG-NH$_2$ (SEQ ID NO:319). The cadherin-14 CAR sequence may, but need not, be present within a cyclic peptide.

Within certain specific embodiments, a modulating agent as provided herein may comprise: (a) one or more cadherin-15 CAR sequences selected from the group consisting of DKF, IDKF (SEQ ID NO:320), DKFT (SEQ ID NO:321), SIDKF (SEQ ID NO:322), IDKFT (SEQ ID NO:323), SIDKFT (SEQ ID NO:324), DKFTG (SEQ ID NO:325), IDKFTG (SEQ ID NO:326), SIDKFTG (SEQ ID NO:327), FSIDKF (SEQ ID NO:328), FSIDKFT (SEQ ID NO:329), FSIDKFTG (SEQ ID NO:330), VFSIDKF (SEQ ID NO:331), VFSIDKFT (SEQ ID NO:332), VFSIDKFTG (SEQ ID NO:333), DEL, DELT (SEQ ID NO:334), DELTG (SEQ ID NO:335), IDEL (SEQ ID NO:336), IDELT (SEQ ID NO:337), IDELTG (SEQ ID NO:338), SIDEL (SEQ ID NO:339), SIDELT (SEQ ID NO:340), SIDELTG (SEQ ID NO:341), FSIDEL (SEQ ID NO:342), FSIDELT (SEQ ID NO:343), FSIDELTG (SEQ ID NO:344), LFSIDEL (SEQ ID NO:345), LFSIDELT (SEQ ID NO:346) and LFSIDELTG (SEQ ID NO:347); or (b) an analogue of any of the foregoing sequences that differs in one or more substitutions, deletions, additions and/or insertions such that that ability of the analogue to modulate a cadherin-15-mediated function is not substantially diminished. For example, the agent may comprise a linear peptide having the sequence N-Ac-VFSIDKFTG-NH$_2$ (SEQ ID NO:333) or N-Ac-LFSIDELTG-NH$_2$ (SEQ ID NO.347). The cadherin-15 CAR sequence may, but need not, be present within a cyclic peptide.

Within certain specific embodiments, a modulating agent as provided herein may comprise: (a) one or more T-cadherin CAR sequences selected from the group consisting of NEN, INEN (SEQ ID NO:348), NENT (SEQ ID NO:349), RINEN (SEQ ID NO:350), INENT (SEQ ID NO:351), RINENT (SEQ ID NO:352), NENTG (SEQ ID NO:353), INENTG (SEQ ID NO:354), RINENTG (SEQ ID NO.355), FRINEN (SEQ ID NO:356), FRINENT (SEQ ID NO:357), FRINENTG (SEQ ID NO:358), IFRINEN (SEQ ID NO:359), IFRINENT (SEQ ID NO:360) and IFRINENTG (SEQ ID NO:361); or (b) an analogue of any of the foregoing sequences that differs in one or more substitutions, deletions, additions and/or insertions such that that ability of the analogue to modulate a T-cadherin-mediated function is not substantially diminished. For example, the agent may comprise a linear peptide having the sequence N-Ac-IFRINENTG-NH$_2$ (SEQ ID NO:361). The T-cadherin CAR sequence may, but need not, be present within a cyclic peptide.

Within certain specific embodiments, a modulating agent as provided herein may comprise: (a) one or more PB-cadherin CAR sequences selected from the group consisting of EEY, EEYT (SEQ ID NO:362), EEYTG (SEQ ID NO:363), VEEY (SEQ ID NO:364), VEEYT (SEQ ID NO:365), VEEYTG (SEQ ID NO:366), VVEEY (SEQ ID NO:367), VVEEYT (SEQ ID NO:368), VVEEYTG (SEQ ID NO:369), FVVEEY (SEQ ID NO:370), FVEEYT (SEQ ID NO:371), FVEEYTG (SEQ ID NO:372), FFVVEEY (SEQ ID NO:373), FFVVEEYT (SEQ ID NO:374), FFVVEEYTG (SEQ ID NO:375), DEL, DELT (SEQ ID NO:376), DELTG (SEQ ID NO:377), IDEL (SEQ ID NO:378), IDELT (SEQ ID NO:379), IDELTG (SEQ ID NO:380), LIDEL (SEQ ID NO:381), LIDELT (SEQ ID NO:382), LIDELTG (SEQ ID NO:383), FLIDEL (SEQ ID NO:384), FLIDELT (SEQ ID NO:385), FLIDELTG (SEQ ID NO:386), IFLIDEL (SEQ ID NO:387), IFLIDELT (SEQ ID NO:388), IFLIDELTG (SEQ ID NO:389), DPK, DPKT (SEQ ID NO:390), DPKTG (SEQ ID NO:391), VDPK (SEQ ID NO:392), VDPKT (SEQ ID NO:393), VDPKTG (SEQ ID NO:394), TVDPK (SEQ ID NO:395), TVDPKT (SEQ ID NO:396), TVDPKTG (SEQ ID NO:397), FTVDPK (SEQ ID NO:398), FTVDPKT (SEQ ID NO:399), FTVDPKTG (SEQ ID NO:400), HFTVDPK (SEQ ID NO:401), HFTVDPKT (SEQ ID NO:402), HFTVDPKTG (SEQ ID NO:403), DAD, DADT (SEQ ID NO:404), DADTG (SEQ ID NO:405), IDAD (SEQ ID NO:406), IDADT (SEQ ID NO:407), IDADTG (SEQ ID NO:408), DIDAD (SEQ ID NO:409), DIDADT (SEQ ID NO:410), DIDADTG (SEQ ID NO:411), FDIDAD (SEQ ID NO:412), FDIDADT (SEQ ID NO:413), FDIDADTG (SEQ ID NO:414), IFDIDAD (SEQ ID NO:415), IFDIDADT (SEQ ID NO:416) and IFDIDADTG (SEQ ID NO:417); or (b) an analogue of any of the foregoing sequences that differs in one or more substitutions, deletions, additions and/or insertions such that that ability of the analogue to modulate a PB-cadherin-mediated function is not substantially diminished. For example, the agent may comprise a linear peptide having the sequence N-Ac-FFVVEEYTG-NH$_2$ (SEQ ID NO:375), N-Ac-IFLIDELTG-NH$_2$ (SEQ ID NO:389), N-Ac-HFTVDPKTG-NH$_2$ (SEQ ID NO:403) or N-Ac-IFDIDADTG-NH$_2$ (SEQ ID NO:417). The PB-cadherin CAR sequence may, but need not, be present within a cyclic peptide.

Within certain specific embodiments, a modulating agent as provided herein may comprise: (a) one or more LI-cadherin CAR sequences selected from the group consisting of NNK, NNKT (SEQ ID NO:418), NNKTG (SEQ ID NO:419), INNK (SEQ ID NO:420), INNKT (SEQ ID NO:421), INNKTG (SEQ ID NO:422), QINNK (SEQ ID NO:423), QINNKT (SEQ ID NO:424), QINNKTG (SEQ ID NO:425), FQINNK (SEQ ID NO:426), FQINNKT (SEQ ID NO:427), FQINNKTG (SEQ ID NO:428), YFQINNK (SEQ ID NO:429), YFQINNKT (SEQ ID NO:430) and YFQINNKTG (SEQ ID NO:431); or (b) an analogue of any of the foregoing sequences that differs in one or more substitutions, deletions, additions and/or insertions such that that ability of the analogue to modulate a LI-cadherin-mediated function is not substantially diminished. For example, the agent may comprise a linear peptide having the sequence N-Ac-YFQINNKTG-NH$_2$ (SEQ ID NO:431). The LI-cadherin CAR sequence may, but need not, be present within a cyclic peptide.

Within certain specific embodiments, a modulating agent as provided herein may comprise: (a) one or more protocadherin CAR sequences selected from the group consisting of DLV, DLVT (SEQ ID NO:432), DLVTG (SEQ ID NO:433), LDLV (SEQ ID NO:434), LDLVT (SEQ ID NO:435), LDLVTG (SEQ ID NO:436), ALDLV (SEQ ID NO:437), ALDLVT (SEQ ID NO:438), ALDLVTG (SEQ ID NO:439), FALDLV (SEQ ID NO:440), FALDLVT (SEQ ID NO:441), FALDLVTG (SEQ ID NO:442), LFALDLV (SEQ ID NO:443), LFALDLVT (SEQ ID NO:444), LFALDLVTG (SEQ ID NO:445), NRD, NRDN (SEQ ID NO:446), NRDNG (SEQ ID NO:447), INRD (SEQ ID NO:448), INRDN (SEQ ID NO:449), INRDNG (SEQ ID NO:450), TINRD (SEQ ID NO:451), TINRDN (SEQ ID NO:452), TINRDNG (SEQ ID NO:453), FTINRD (SEQ ID NO:454), FTINRDN (SEQ ID NO:455), FTINRDNG (SEQ ID NO:456), YFTINRD (SEQ ID NO:457), YFTINRDN (SEQ ID NO:458), YFTINRDNG (SEQ ID NO:459), DPK, DPKT (SEQ ID NO:460), DPKTG (SEQ ID NO:461), IDPK (SEQ ID NO:462), IDPKT (SEQ ID NO:463), IDPKTG (SEQ ID NO:464), SIDPK (SEQ ID NO:465), SIDPKT (SEQ ID NO:466), SIDPKTG (SEQ ID NO:467), FSIDPK (SEQ ID NO:468), FSIDPKT (SEQ ID NO:469), FSIDPKTG (SEQ ID NO:470), LFSIDPK (SEQ ID NO:471), LFSIDPKT (SEQ ID NO:472), LFSIDPKTG (SEQ ID NO:473), DPS, DPSS (SEQ ID NO:474), DPSSG (SEQ ID NO:475), IDPS (SEQ ID NO:476), IDPSS (SEQ ID NO:477), IDPSSG (SEQ ID NO:478), EIDPS (SEQ ID NO:479), EIDPSS (SEQ ID NO:480), EIDPSSG (SEQ ID NO:481), FEIDPS (SEQ ID NO:482), FEIDPSS (SEQ ID NO:483), FEIDPS (SEQ ID NO:484), FEIDPSS (SEQ ID NO:485), FEIDPSSG (SEQ ID NO:486), LFEIDPS (SEQ ID NO:487), LFEIDPSS (SEQ ID NO:488) and LFEIDPSSG (SEQ ID NO:489); or (b) an analogue of any of the foregoing sequences that differs in one or more substitutions, deletions, additions and/or insertions such that that ability of the analogue to modulate a protocadherin-mediated function is not substantially diminished. For example, the agent may comprise a linear peptide having the sequence N-Ac-LFALDLVTC-NH$_2$ (SEQ ID NO:445), N-Ac-YFTINRDNG-NH$_2$ (SEQ ID NO:459), N-Ac-LFSIDPKTG-NH$_2$ (SEQ ID NO:473) or N-Ac-LFEIDPSSG-NH$_2$ (SEQ ID NO:489). The protocadherin CAR sequence may, but need not, be present within a cyclic peptide.

Within certain specific embodiments, a modulating agent as provided herein comprises: (a) one or more desmoglein CAR sequences selected from the group consisting of NQK, NQKT (SEQ ID NO:490), NQKTG (SEQ ID NO:491), INQK (SEQ ID NO:492), INQKT (SEQ ID NO:493), INQKTG (SEQ ID NO:494), VINQK (SEQ ID NO:495), VINQKT (SEQ ID NO:496), VINQKTG (SEQ ID NO:497), FVINQK (SEQ ID NO:498), FVINQKT (SEQ ID NO:499), FVINQKTG (SEQ ID NO:500), IFVINQK (SEQ ID NO:501), IFVINQKT (SEQ ID NO:502), IFVINQKTG (SEQ ID NO:503), NRN, NRNT (SEQ ID NO:504), NRNTG (SEQ ID NO:505), INRN (SEQ ID NO:506), INRNT (SEQ ID NO:507), INRNTG (SEQ ID NO:508), IINRN (SEQ ID NO:509), IINRNT (SEQ ID NO:510), IINRNTG (SEQ ID NO:511), FIINRN (SEQ ID NO:512), FIINRNT (SEQ ID NO:513), FIINRNTG (SEQ ID NO:514), MFIINRN (SEQ ID NO:515), MFIINRNT (SEQ ID NO:516), MFIINRNTG (SEQ ID NO:517), NKD, NKDT (SEQ ID NO:518), NKDTG (SEQ ID NO:519), LNKD (SEQ ID NO:520), LNKDT (SEQ ID NO:521), LNKDTG (SEQ ID NO:522), YLNKD (SEQ ID NO:523), YLNKDT (SEQ ID NO:524), YLNKDTG (SEQ ID NO:525), FYLNKD (SEQ ID NO:526), FYLNKDT (SEQ ID NO:527), FYLNKDTG (SEQ ID NO:528), VFYLNKD (SEQ ID NO:529), VFYLNKDT (SEQ ID NO:530) and VFYLNKDTG (SEQ ID NO:531); or (b) an analogue of any of the foregoing sequences that differs in one or more substitutions, deletions, additions and/or insertions such that that ability of the analogue to modulate a desmoglein-mediated function is not substantially diminished. For example, the agent may comprise a linear peptide having the sequence N-Ac-IFVINQKTG-NH$_2$ (SEQ ID NO:503), N-Ac-MFIINRNTG-NH$_2$ (SEQ ID NO:517) or N-Ac-VFYLNKDTG-NH$_2$ (SEQ ID NO:531). The desmoglein CAR sequence may, but need not, be present within a cyclic peptide.

Within certain specific embodiments, a modulating agent as provided herein may comprise: (a) one or more desmocollin CAR sequences selected from the group consisting of EKD, EKDT (SEQ ID NO:532), EKDTG (SEQ ID NO:533), IEKD (SEQ ID NO:534), IEKDT (SEQ ID NO:535), IEKDTG (SEQ ID NO:536), YIEKD (SEQ ID NO:537), YIEKDT (SEQ ID NO:538), YIEKDTG (SEQ ID NO:539), FYIEKD (SEQ ID NO:540), FYIEKDT (SEQ ID NO:541), FYIEKDTG (SEQ ID NO:542), LFYIEKD (SEQ ID NO:543), LFYIEKDT (SEQ ID NO:544), LFYIEKDTG (SEQ ID NO:545), ERD, ERDT (SEQ ID NO:546), ERDTG (SEQ ID NO:547), VERD (SEQ ID NO:548), VERDT (SEQ ID NO:549), VERDTG (SEQ ID NO:550), YVERD (SEQ ID NO:551), YVERDT (SEQ ID NO:552), YVERDTG (SEQ ID NO:553), FYVERD (SEQ ID NO:554), FYVERDT (SEQ ID NO:555), FYVERDTG (SEQ ID NO:556), LFYVERD (SEQ ID NO:557), LFYVERDT (SEQ ID NO:558), LFYVERDTG (SEQ ID NO:559), IERD (SEQ ID NO:560), IERDT (SEQ ID NO:561), IERDTG (SEQ ID NO:562), YIERD (SEQ ID NO:563), YIERDT (SEQ ID NO:564), YIERDTG (SEQ ID NO:565), FYIERD (SEQ ID NO:566), FYIERDT (SEQ ID NO:567), FYIERDTG (SEQ ID NO:568), LFYIERD (SEQ ID NO:569), LFYIERDT (SEQ ID NO:570) and LFYIERDTG (SEQ ID NO:571); or (b) an analogue of any of the foregoing sequences that differs in one or more substitutions, deletions, additions and/or insertions such that that ability of the analogue to modulate a desmocollin-mediated function is not substantially diminished. For example, the agent may comprise a linear peptide having the sequence N-Ac-LFYIEKDTG-NH$_2$ (SEQ ID NO:545), N-Ac-LFYVERDTG-NH$_2$ (SEQ ID NO:559) or N-Ac-LFYIERDTG-NH$_2$ (SEQ ID NO:571). The desmocollin CAR sequence may, but need not, be present within a cyclic peptide.

Within certain specific embodiments, a modulating agent as provided herein comprises: (a) one or more cadherin-related neuronal receptor (cnr) CAR sequences selected from the group consisting of DPV, DPVS (SEQ ID NO:572), DPVSG (SEQ ID NO:573), IDPV (SEQ ID NO:574), IDPVS (SEQ ID NO:575), IDPVSG (SEQ ID NO:576), HIDPV (SEQ ID NO:577), HIDPVS (SEQ ID NO:578), HIDPVSG (SEQ ID NO:579), FHIDPV (SEQ ID NO:580), FHIDPVS (SEQ ID NO:581), FHIDPVSG (SEQ ID NO:582), KFHIDPV (SEQ ID NO:583), KFHIDPVS (SEQ ID NO:584), KFHIDPVSG (SEQ ID NO:585), DAD, DADT (SEQ ID NO:586), DADTG (SEQ ID NO:587), IDAD (SEQ ID NO:588), IDADT (SEQ ID NO:589), IDADTG (SEQ ID NO:590), SIDAD (SEQ ID NO:591), SIDADT (SEQ ID NO:592), SIDADTG (SEQ ID NO:593), FSIDAD (SEQ ID NO:594), FSIDADT (SEQ ID NO:595), FSIDADTG (SEQ ID NO:596), QFSIDAD (SEQ ID NO:597), QFSIDADT (SEQ ID NO:598), QFSIDADTG (SEQ ID NO:599), DSV, DSVS (SEQ ID NO:600), DSVSG (SEQ ID NO:601), IDSV (SEQ ID NO:602), IDSVS (SEQ ID NO:603), IDSVSG (SEQ ID NO:604), HIDSV (SEQ ID NO:605), HIDSVS (SEQ ID NO:606), HIDSVSG (SEQ ID NO:607), FHIDSV (SEQ ID NO:608), FHIDSVS (SEQ ID NO:609), FHIDSVSG (SEQ ID NO:610), TFHIDSV (SEQ ID NO:611), TFHIDSVS (SEQ ID NO:612), TFHIDSVSG (SEQ ID NO:613), DSN, DSNS (SEQ ID NO:614), DSNSG (SEQ ID NO:615), IDSN (SEQ ID NO:616), IDSNS (SEQ ID NO:617), IDSNSG (SEQ ID NO:618), NIDSN (SEQ ID NO:619), NIDSNS (SEQ ID NO:620), NIDSNSG (SEQ ID NO:621), FNIDSN (SEQ ID NO:622), FNIDSNS (SEQ ID NO:623), FNIDSNSG (SEQ ID NO:624), AFNIDSN (SEQ ID NO:625), AFNIDSNS (SEQ ID NO:626), AFNIDSNSG (SEQ ID NO:627), DSS, DSSS (SEQ ID NO:628), DSSSG (SEQ ID NO:629), IDSS (SEQ ID NO:630), IDSSS (SEQ ID NO:631), IDSSSG (SEQ ID NO:632), TIDSS (SEQ ID NO:633), TIDSSS (SEQ ID NO:634), TIDSSSG (SEQ ID NO:635), FTIDSS (SEQ ID NO:636), FTIDSSS (SEQ ID NO:637), FTIDSSSG (SEQ ID NO:638), KFTIDSS (SEQ ID NO:639), KFTIDSSS (SEQ ID NO:640), KFTIDSSSG (SEQ ID NO:641), DEK, DEKN (SEQ ID NO:642), DEKNG (SEQ ID NO:643), LDEK (SEQ ID NO:644), LDEKN (SEQ ID NO:645), LDEKNG (SEQ ID NO:646), TLDEK (SEQ ID NO:647), TLDEKN (SEQ ID NO:648), TLDEKNG (SEQ ID NO:649), FTLDEK (SEQ ID NO:650), FTLDEKN (SEQ ID NO:651), FTLDEKNG (SEQ ID NO:652), LFTLDEK (SEQ ID NO:653), LFTLDEKN (SEQ ID NO:654), LFTLDEKNG (SEQ ID NO:655), NEK, NEKT (SEQ ID NO:656), NEKTG (SEQ ID NO:657), INEK (SEQ ID NO:658), INEKT (SEQ ID NO:659), INEKTG (SEQ ID NO:660), LINEK (SEQ ID NO:661), LINEKT (SEQ ID NO:662), LINEKTG (SEQ ID NO:663), FLINEK (SEQ ID NO:664), FLINEKT (SEQ ID NO:665), FLINEKTG (SEQ ID NO:666), KFLINEK (SEQ ID NO:667), KFLINEKT (SEQ ID NO:668) and KFLINEKTG (SEQ ID NO:4052); or (b) an analogue of any of the foregoing sequences that differs in one or more substitutions, deletions, additions and/or insertions such that that ability of the analogue to modulate a cadherin-related neuronal receptor-mediated function is not substantially diminished. For example, the agent may comprise a linear peptide having the sequence N-Ac-KFHIDPVSG-NH$_2$ (SEQ ID NO:585), N-Ac-QFSIDADTG-NH$_2$ (SEQ ID NO:599), N-Ac-TFHIDSVSG-NH$_2$ (SEQ ID NO:613), N-Ac-AFNIDSNSG-NH$_2$ (SEQ ID NO:627), N-Ac-KFTIDSSSG-NH$_2$ (SEQ ID NO:641), N-Ac-LFTLDEKNG-NH$_2$ (SEQ ID NO:655) or N-Ac-KFLINEKTG-NH$_2$ (SEQ ID NO:4052). The cnr CAR sequence may, but need not, be present within a cyclic peptide.

Any of the above modulating agents may, within certain embodiments, be linked to one or more of a drug, detectable marker, targeting agent or support material. Alternatively, or in addition, a modulating agent as described above, may further comprise one or more of: (a) a CAR sequence that is specifically recognized by an adhesion molecule other than the particular nonclassical cadherin; and/or (b) an antibody or antigen-binding fragment thereof that specifically binds to a CAR sequence that is specifically recognized by an adhesion molecule other than the nonclassical cadherin. For example, such an adhesion molecule may be a classical cadherin, integrin, occludin, claudin, N-CAM, fibronectin, laminin or other extracellular matrix protein. In addition, or alternatively, a modulating agent may comprise a CAR sequence from a different non-classical cadherin, such that multiple non-classical cadherin CAR sequences are linked together within the modulating agent.

Within other aspects, the present invention provides pharmaceutical compositions comprising a modulating agent as described above in combination with a pharmaceutically acceptable carrier. Within such compositions, the modulating agent may, but need not, be present within a sustained-release formulation. Such compositions may, within certain embodiments, further comprise a drug and/or a modulator of cell adhesion that comprises one or more of: (a) a CAR sequence that is specifically recognized by an adhesion molecule other than the nonclassical cadherin; and/or (b) an antibody or antigen-binding fragment thereof that specifically binds to a CAR sequence that is specifically recognized by an adhesion molecule other than the nonclassical cadherin.

The present invention further provides, within other aspects, methods for modulating one or more nonclassical cadherin-mediated functions. Such methods generally comprise contacting a nonclassical cadherin-expressing cell with a modulating agent as described above. Suitable cells include, but are not limited to, epithelial cells, endothelial cells, neural cells, tumor cells and lymphocytes. Within such methods, the modulating agent may, but need not, be present within a pharmaceutical composition as recited above.

Within certain aspects, methods are provided for inhibiting adhesion of nonclassical cadherin-expressing cells in a mammal, comprising administering to a mammal a modulating agent as provided above that inhibits cell adhesion mediated by the nonclassical cadherin. Such modulating agents should inhibit cell adhesion with an activity that is not substantially diminished relative to the activity of the nonclassical cadherin in soluble form, within a cell adhesion assay such as the assays provided herein.

Within further aspects, the present invention provides methods for enhancing the delivery of a drug through the skin of a mammal, comprising contacting epithelial cells of a mammal with a drug and a modulating agent as described above, wherein the step of contacting is performed under conditions and for a time sufficient to allow passage of the drug across the epithelial cells, and wherein the modulating agent inhibits nonclassical cadherin-mediated cell adhesion. Such modulating agents may pass into the blood stream of the mammal. Within certain embodiments, the modulating agent is linked to the drug. The step of contacting may, but need not, be performed via a skin patch comprising the modulating agent and the drug, and such skin patches are further provided herein. Preferred modulating agents for use within such methods are those that inhibit cell adhesion mediated by OB-cadherin, cadherin-5, a desmoglein and/or a desmocollin, as described herein.

Methods are further provided for facilitating blood sampling in a mammal, comprising contacting epithelial cells of a mammal with a modulating agent as described above, wherein the modulating agent inhibits nonclassical cadherin-mediated cell adhesion, and wherein the step of contacting is performed under conditions and for a time sufficient to allow passage of one or more blood components across the epithelial cells. Preferred modulating agents for use within such methods are those that inhibit cell adhesion mediated by OB-cadherin, cadherin-5, a desmoglein and/or a desmocollin, as described herein. The step of contacting may be performed via a skin patch comprising the modulating agent, and (optionally) a reagent for detecting a blood component of interest, and such kits are specifically provided herein. Within certain embodiments, the epithelial cells are skin cells or are gum cells.

Within further aspects, methods are provided for enhancing the delivery of a drug to a tumor in a mammal, comprising administering to a mammal a modulating agent as described above, wherein the modulating agent inhibits nonclassical cadherin-mediated cell adhesion. Suitable tumors include, but are not limited to, bladder tumors, ovarian tumors, breast tumors, stomach tumors and kidney tumors, and the modulating agent may be administered locally to the tumor or may be administered systemically. Preferred modulating agents for use within such methods are those that inhibit cell adhesion mediated by OB-cadherin, cadherin-5, cadherin-6, a desmoglein and/or a desmocollin, as described herein.

Within other aspects, the present invention provides methods for treating cancer and/or inhibiting metastasis in a mammal, comprising administering to a mammal a modulating agent as described above, wherein the modulating agent inhibits cadherin-mediated cell adhesion. The mammal may be afflicted with a cancer such as a carcinoma, leukemia or melanoma, and the modulating agent may be administered to the tumor or systemically. Preferred modulating agents for use within such methods are those that inhibit cell adhesion mediated by OB-cadherin, cadherin-5, cadherin-6, a desmoglein and/or a desmocollin, as described herein.

Within other aspects, methods are provided for inhibiting angiogenesis in a mammal, comprising administering to a mammal a modulating agent as described above, wherein the modulating agent inhibits nonclassical cadherin-mediated cell adhesion. Preferred modulating agents for use within such methods are those that inhibit cell adhesion mediated by cadherin-5, as described herein.

The present invention further provides, within other aspects, methods for inducing apoptosis in a nonclassical cadherin-expressing cell, comprising contacting a nonclassical cadherin-expressing cell with a modulating agent as described above, wherein the modulating agent inhibits nonclassical cadherin-mediated cell adhesion.

In further aspects, methods are provided for preventing or treating obesity in a mammal, comprising administering to a mammal a modulating agent as described above, wherein the modulating agent inhibits an OB-cadherin and/or cadherin-5 mediated function.

Methods are further provided for stimulating blood vessel regression, comprising administering to a mammal a modulating agent as described above, wherein the modulating agent inhibits an OB-cadherin and/or cadherin-5 mediated function.

The present invention further provides, within other aspects, methods for enhancing drug delivery to the central nervous system of a mammal, comprising administering to a mammal a modulating agent as described above, wherein the modulating agent inhibits a nonclassical cadherin-mediated function. Preferably, the modulating agent inhibits an OB-cadherin and/or cadherin-5 mediated function.

The present invention further provides, in other aspects, methods for enhancing and/or directing neurite outgrowth, comprising contacting a neuron with a modulating agent as described above, wherein the modulating agent enhances a nonclassical cadherin-mediated function. Preferably, the modulating agent enhances a function mediated by cadherin-7, cadherin-8, cadherin-12, cadherin-14, cadherin-15, T-cadherin, PB-cadherin, a protocadherin and/or a cnr.

Methods are also provided, within further aspects, for treating a demyelinating neurological disease such as multiple sclerosis in a mammal, comprising administering to a mammal a modulating agent as described above. Within certain embodiments, the modulating agent is administered by implantation with Schwann cells, oligodendrocyte progenitor cells and/or oligodendrocytes. Preferably, the modulating agent enhances a function mediated by cadherin-7, cadherin-8, cadherin-12, cadherin-14, cadherin-15, T-cadherin, PB-cadherin, a protocadherin and/or a cnr.

Methods are further provided for increasing vasopermeability in a mammal, comprising administering to a mammal a modulating agent as described above, wherein the modulating agent inhibits a nonclassical cadherin-mediated function. Preferably, the modulating agent inhibits OB-cadherin and/or cadherin-5 mediated cell adhesion.

Within other aspects, the present invention provides methods for enhancing adhesion of nonclassical cadherin-expressing cells, comprising contacting nonclassical cadherin-expressing cells with a modulating agent as described above, wherein the modulating agent enhances nonclassical cadherin-mediated cell adhesion, wherein the step of contacting is performed under conditions and for a time sufficient to detectably enhance adhesion of the cells. Within certain embodiments, modulating agents for use within such methods are linked to a support molecule or a solid support.

Within related aspects, the present invention provides methods for facilitating wound healing and/or reducing scar tissue in a mammal, comprising contacting a wound in a mammal with a modulating agent as described above, wherein the modulating agent enhances cadherin-mediated cell adhesion. Preferably, the modulating agent enhances OB-cadherin, cadherin-5, desmoglein and/or desmocollin mediated cell adhesion. Within certain embodiments, modulating agents for use within such methods are linked to a support molecules or a solid support.

Methods are also provided, within other aspects, for enhancing adhesion of foreign tissue implanted within a mammal, comprising contacting a site of implantation of foreign tissue in a mammal with a modulating agent as described above, wherein the modulating agent enhances nonclassical cadherin-mediated cell adhesion. Such foreign tissue may be a skin graft or organ implant. Within certain embodiments, the modulating agent is linked to a support material. Preferably, the modulating agent enhances OB-cadherin, cadherin-5, desmoglein and/or desmocollin mediated cell adhesion. Within certain embodiments, modulating agents for use within such methods are linked to a support molecules or a solid support.

Within further aspects, the present invention provides methods for inhibiting synaptic stability in a mammal, comprising administering to a mammal a modulating agent as described above, wherein the modulating agent inhibits a cnr-mediated function.

Within further aspects, methods are provided for modulating the immune system of a mammal, comprising administering to a mammal a modulating agent as described above, wherein the modulating agent inhibits a nonclassical cadherin-mediated function. Preferably, the modulating agent inhibits OB-cadherin, cadherin-5, cadherin-6 and/or cadherin-8 mediated cell adhesion.

Within other aspects, the present invention provides methods for preventing pregnancy in a mammal, comprising administering to a mammal a modulating agent as described above, wherein the modulating agent inhibits a nonclassical cadherin-mediated fuiction. Preferably, the modulating agent inhibits OB-cadherin or cadherin-5 mediated cell adhesion.

The present invention further provides methods for detecting the presence of nonclassical cadherin-expressing cells in a sample, comprising: (a) contacting a sample with an antibody or antigen-binding fragment thereof that binds to a nonclassical CAR sequence as described above under conditions and for a time sufficient to allow formation of an antibody-cadherin complex; and (b) detecting the level of antibody-cadherin complex, and therefrom detecting the presence of nonclassical cadherin expressing cells in a sample. The antibody may be linked to a support material or a detectable marker such as a fluorescent marker. In certain embodiments, the step of detecting is performed using fluorescence activated cell sorting.

Kits for detecting the presence of cadherin-expressing cells in a sample are also provided. Such kits may comprise: (a) an antibody or antigen-binding fragment thereof that specifically binds to a nonclassical cadherin CAR sequence; and (b) a detection reagent.

Within other aspects, the present invention provides methods for identifying a compound capable of modulating a nonclassical cadherin-mediated function, comprising: (a) contacting an antibody or antigen-binding fragment thereof that specifically binds to a nonclassical cadherin CAR sequence as described above with a test compound; and (b) detecting the level of antibody or fragment that binds to the test compound, and therefrom identifying a compound capable of modulating cadherin-mediated cell adhesion.

These and other aspects of the present invention will become apparent upon reference to the following detailed description and attached drawings. All references disclosed herein are hereby incorporated by reference in their entirety as if each was incorporated individually.

BRIEF DESCRIPTION OF THE DRAWINGS

FIG. 2 provides the amino acid sequences of representative mammalian nonclassical cadherin extracellular domains, as indicated (SEQ ID NOs 4–43). Calcium binding motifs are shown in bold, and representative CAR sequences are shown in bold and underlined.

FIG. 3 provides the amino acid sequences of representative mammalian OB-cadherin EC1 domains: human OB-cadherin (SEQ ID NO:44) and mouse OB-cadherin (SEQ ID NO:45).

FIG. 5A shows the cells 24 hours after exposure to 100 $\mu$l water/1 ml culture medium (magnification 200×). FIGS. 5B and 5C show the cells 24 hours after exposure to 100 $\mu$L of a solution containing 10 mg/mL N-Ac-IFVIDDKSG-NH$_2$ (SEQ ID NO:85) per 1 mL culture medium (magnifications of 200× and 100×, respectively). Arrows indicate rounded cells.

FIGS. 6C and 6D show the cells in the presence of 75 $\mu$g/mL of a similar peptide without the terminal functional groups. Cells were incubated with peptide for 60 minutes, fixed and immunolabeled with monoclonal antibodies directed against VE-cadherin, and were observed at 400× (A, C and E) and 1000× (B, D and F).

DETAILED DESCRIPTION OF THE INVENTION

Figure 1A:
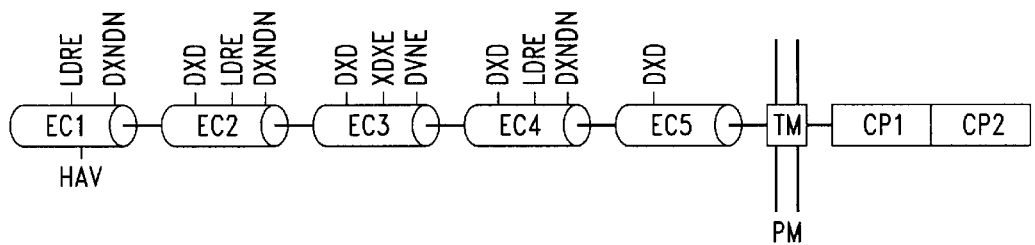
FIGS. 1A–1AA are diagrams depicting the structure of classical (FIG. 1A) and nonclassical cadherins (FIGS. 1B to 1AA). The extracellular domains are designated EC1–EC5 for most cadherins; EC1–EC7 for LI-cadherin and EC1–EC6 for protocadherins and cnr. The hydrophobic domain that transverses the plasma membrane (PM) is represented by TM, and the varying number of cytoplasmic domains are represented by CP. The calcium binding motifs for classical cadherins are shown in FIG. 1A by DXNDN (SEQ ID NO:1), DXD and LDRE (SEQ ID NO:2), and the calcium binding motifs for other cadherins are also indicated above the extracellular domains. Below the extracellular domains, the nine amino acid CAR sequences are shown.

As noted above, the present invention provides methods for modulating cadherin-mediated functions, such as cell adhesion. The present invention is based upon the identification of previously unknown cell adhesion recognition (CAR) sequences present in nonclassical cadherins. A modulating agent may generally comprise one or more nonclassical cadherin CAR sequences (or analogues or minietics thereof), with or without one or more additional CAR sequences, as described below. Peptide CAR sequences may be present within a linear or cyclic peptide. Alternatively, or in addition, a modulating agent may comprise a polynucleotide encoding a peptide comprising one or more nonclassical cadherin CAR sequences and/or a modulating agent may comprise a substance (such as an antibody or antigen-binding fragment thereof) that specifically binds to a nonclassical cadherin CAR sequence.

In general, to modulate a nonclassical cadherin-mediated function, a cell that expresses a nonclassical cadherin is contacted with a modulating agent either in vivo or in vitro. Within certain aspects, the methods provided herein inhibit a nonclassical cadherin-mediated function. Such methods include, for example, methods for treating diseases or other conditions characterized by undesirable cell adhesion or for facilitating drug delivery to a specific tissue or tumor. Certain methods may inhibit cell adhesion (e.g., cancer cell adhesion), as well as cancer invasion and metastasis. Alternatively, a modulating agent may, such as when linked to a matrix or to another modulating agent via a linker, be used to enhance a nonclassical cadherin-mediated function, such as cell adhesion. Such conjugates may be used, for example, to facilitate wound healing or the adhesion of implants.

Modulating Agents

As noted above, the term "modulating agent," as used herein, refers to a molecule comprising at least one of the following components:

(a) a linear or cyclic peptide sequence that is at least 50% identical to a nonclassical cadherin CAR sequence (ie., a nonclassical cadherin CAR sequence or an analogue thereof that retains at least 50% sequence identity);

(b) a mimetic (e.g., peptidomimetic or small molecule mimic) of a nonclassical cadherin CAR sequence;

(c) a substance, such as an antibody or antigen-binding fragment thereof, that specifically binds a nonclassical cadherin CAR sequence; and/or (d) a polynucleotide encoding a polypeptide that comprises a nonclassical cadherin CAR sequence or analogue thereof.

A modulating agent may consist entirely of one or more of the above elements, or may additionally comprise further peptide and/or non-peptide regions. Additional peptide regions may be derived from a nonclassical cadherin (preferably an extracellular domain that comprises a CAR sequence) and/or may be heterologous. Within certain preferred embodiments, a modulating agent contains no more than 85 consecutive amino acid residues, and preferably no more than 50 consecutive amino acid residues, present within a nonclassical cadherin.

A modulating agent is further capable of modulating a function mediated by a nonclassical cadherin. Such activity may generally be assessed using, for example, representative assays provided herein. Certain modulating agents inhibit an interaction between nonclassical cadherin molecules and/or between a nonclassical cadherin and a different adhesion molecule. For functions (e.g., cell adhesion) that are inhibited by a full length nonclassical cadherin, such a modulating agent may inhibit the function with an activity that is not substantially diminished relative to the full length nonclassical cadherin (i.e., the modulating agent inhibits the function at least as well as soluble cadherin, when contacted with cells that express the cadherin). For example, a modulating agent may be as effective as soluble cadherin in preventing and/or disrupting adhesion of cadherin-expressing cells. Alternatively, to enhance adhesion of nonclassical cadherin-expressing cells, a modulating agent may comprise an antibody or antigen-binding fragment thereof and/or multiple peptides or mimetics linked to a support material. Such modulating agents may function as a biological glue to bind nonclassical cadherin-expressing cells, and should result in a detectable enhancement of cell adhesion (preferably an enhancement that is at least as great as that observed for immobilized cadherin or antibody directed against the cadherin).

Figure 1B:
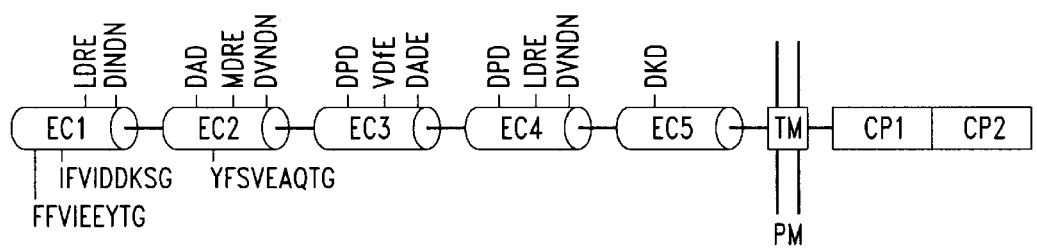
Figure 1C:
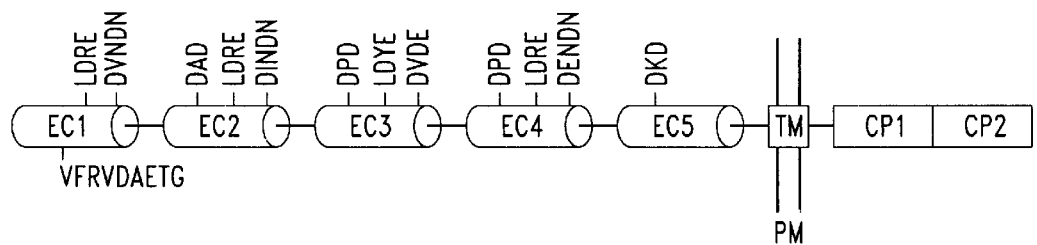
Figure 1D:
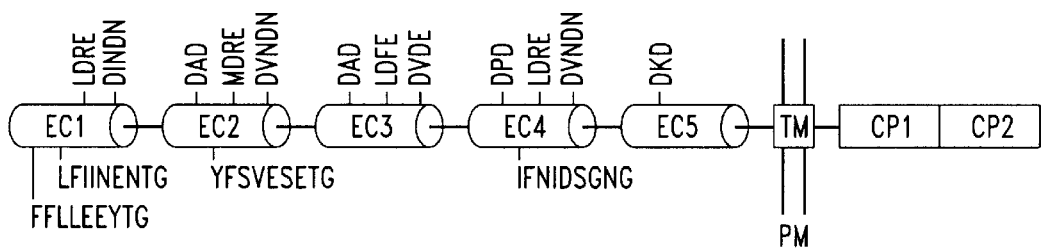
Figure 1E:
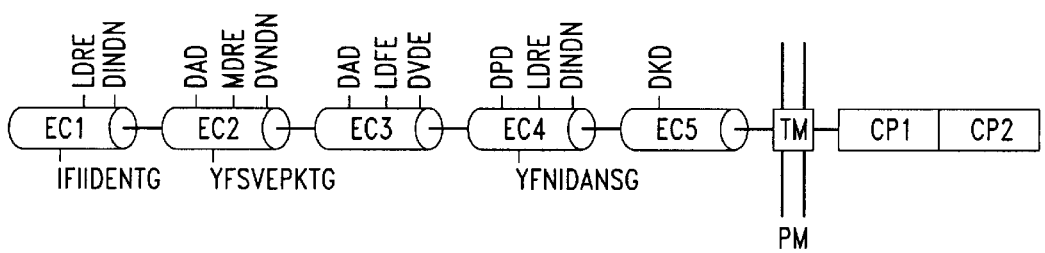
Figure 1F:
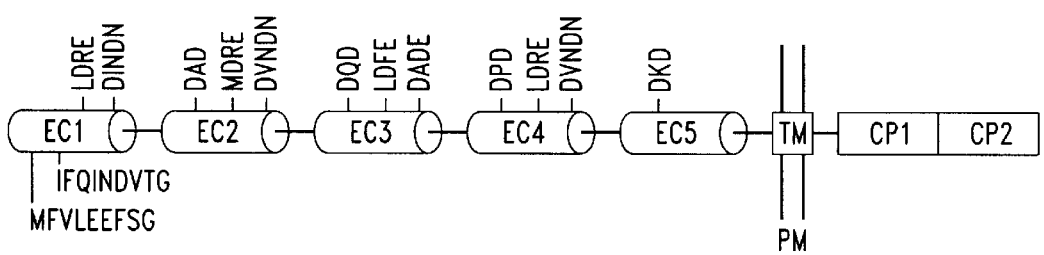
Figure 1G:
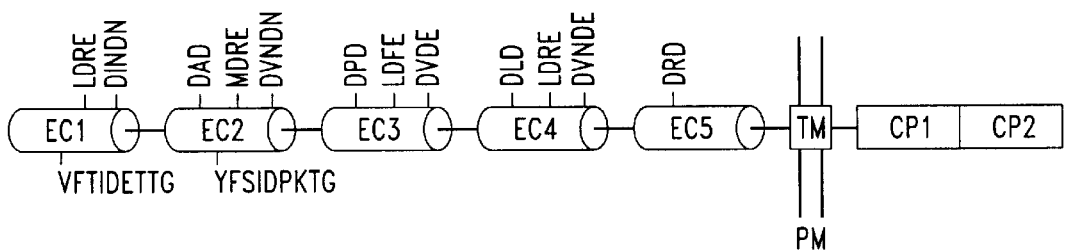
Figure 1H:
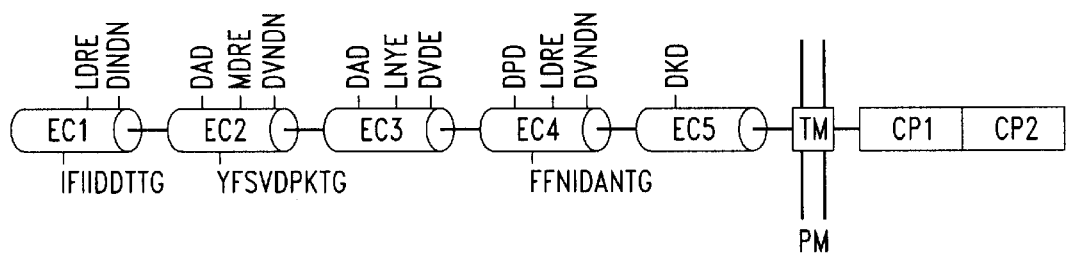
Figure 1I:
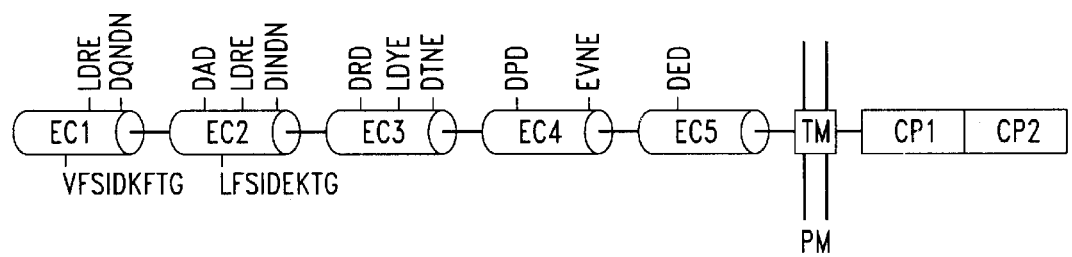
Figure 1J:
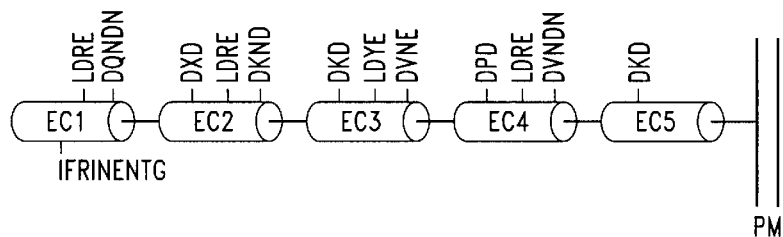
Figure 1K:
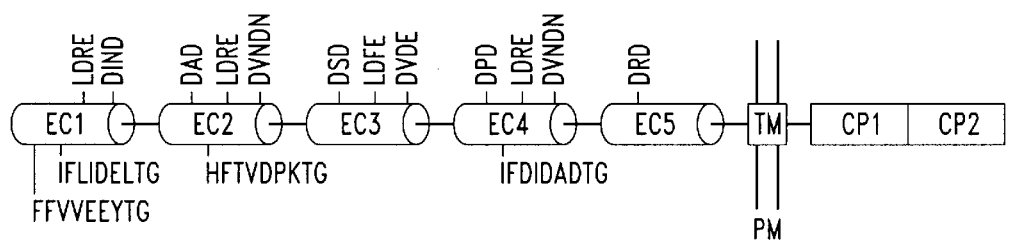
Figure 1L:
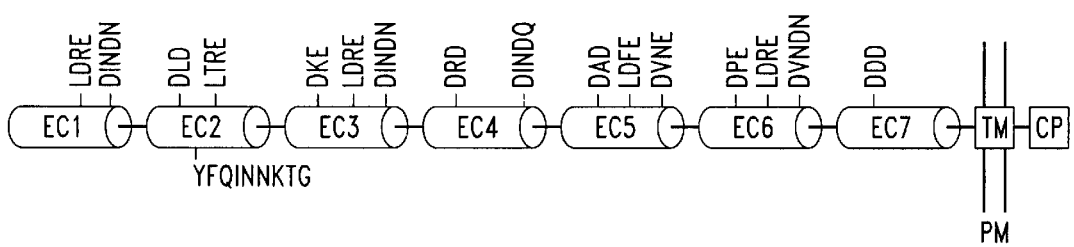
Figure 1M:
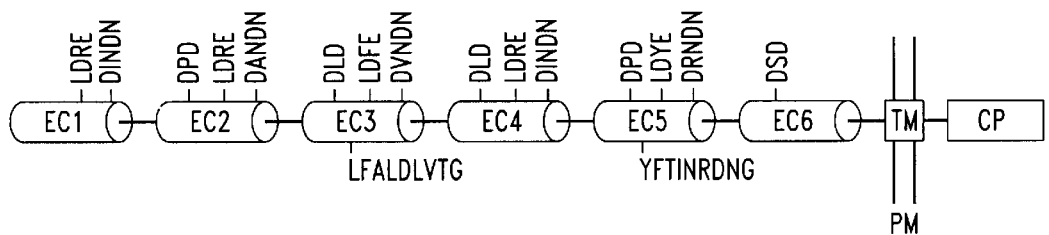
Figure 1N:
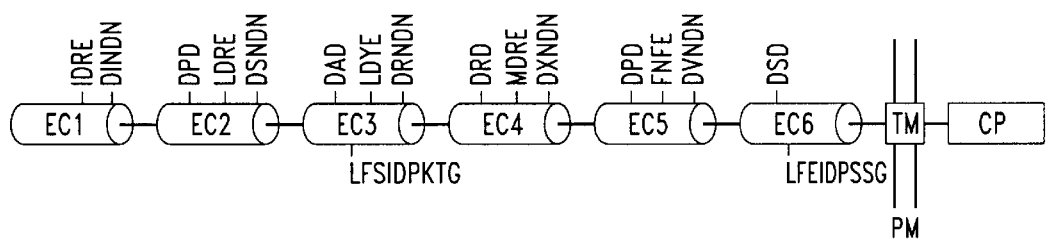
Figure 1O:
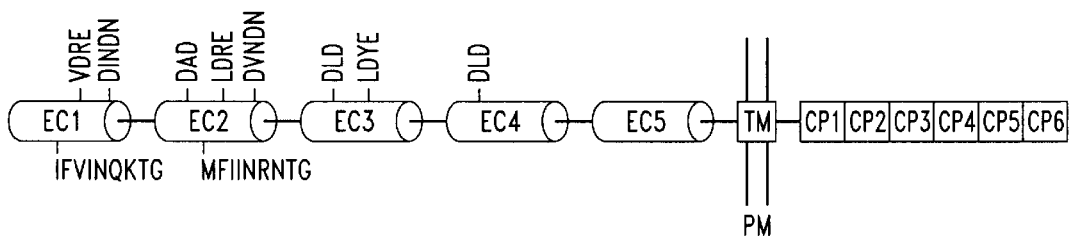
Figure 1P:
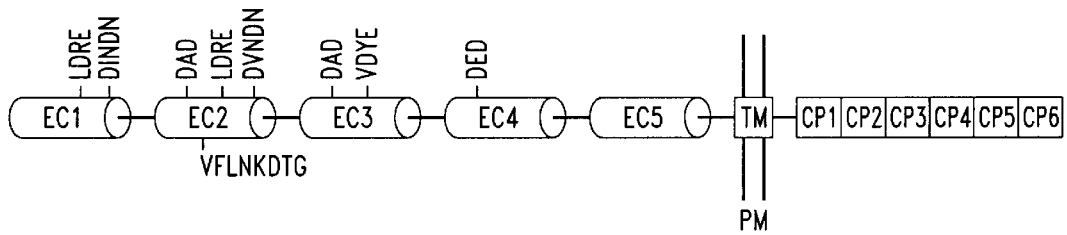
Figure 1Q:
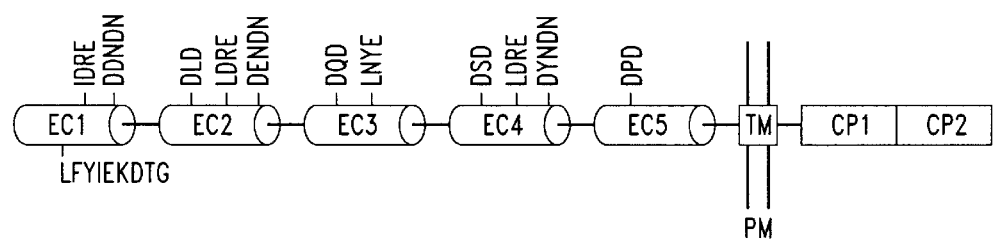
Figure 1R:
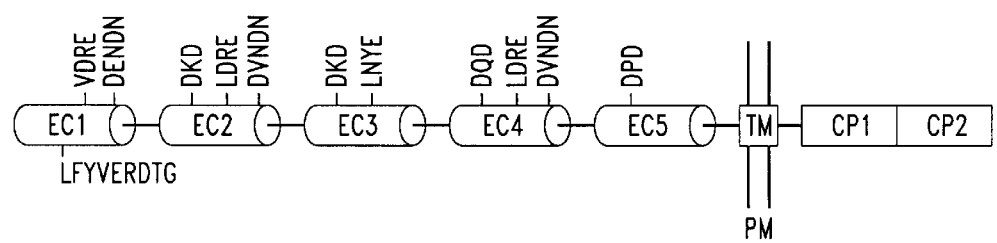
Figure 1S:
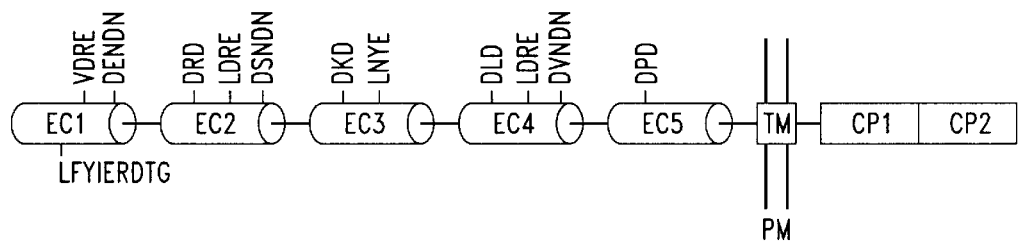
Figure 1T:
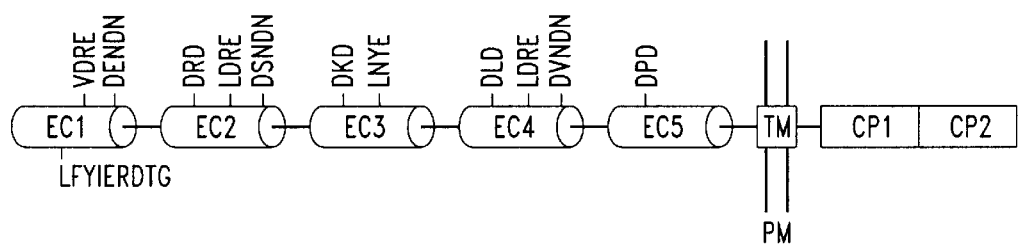
Figure 1U:
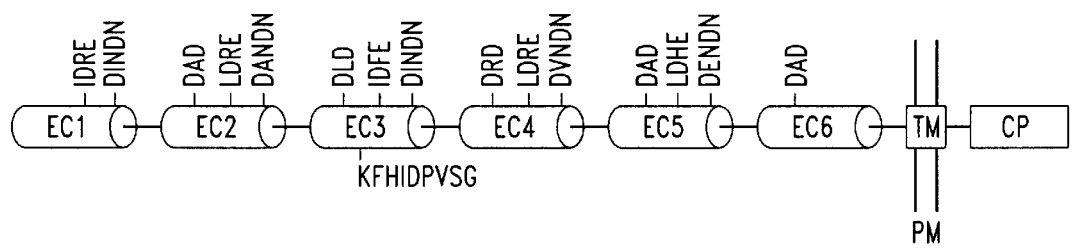
Figure 1V:
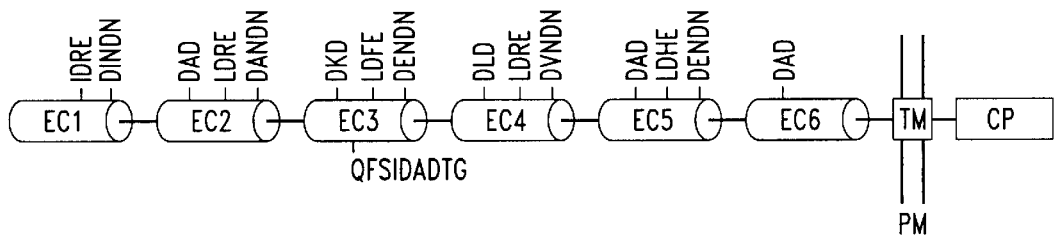
Figure 1W:
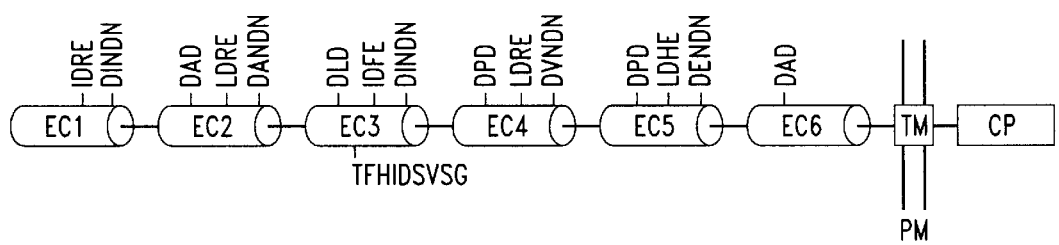
Figure 1X:
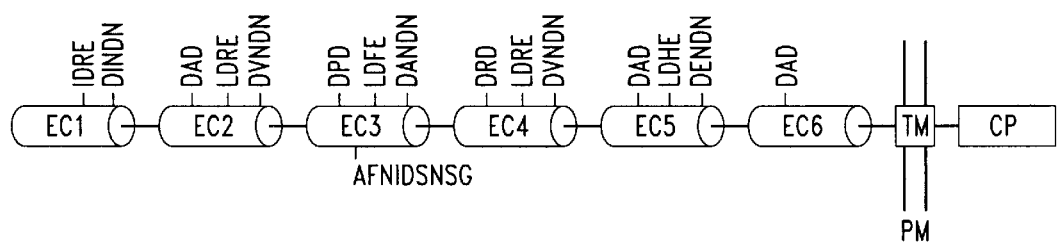
Figure 1Y:
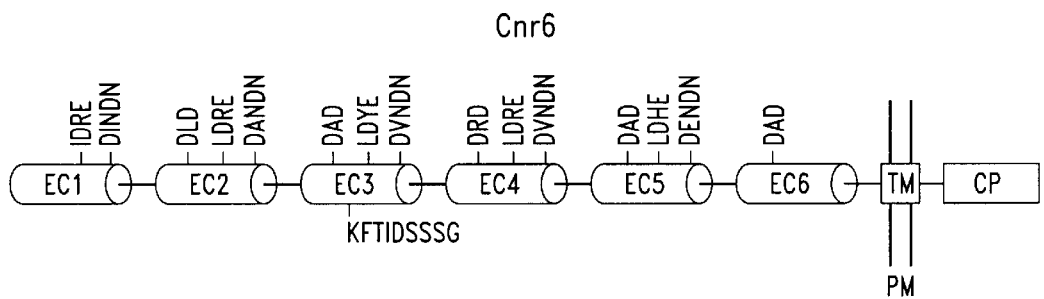
Figure 1Z:
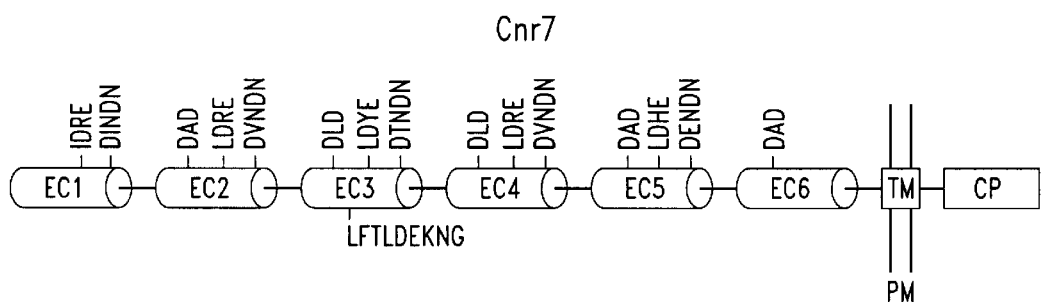
Figure 1A:
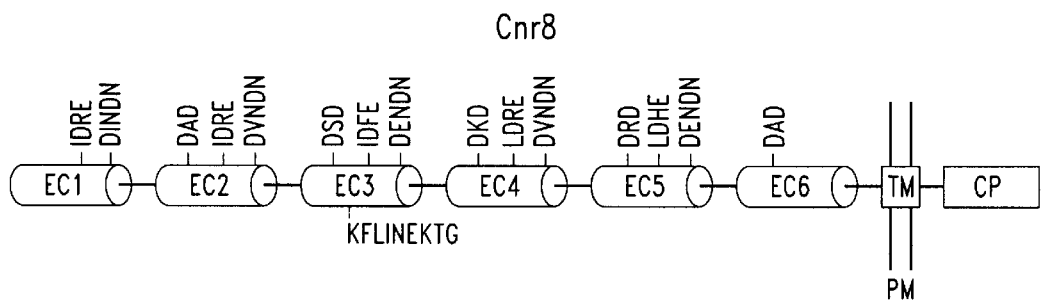
Figure 2B:
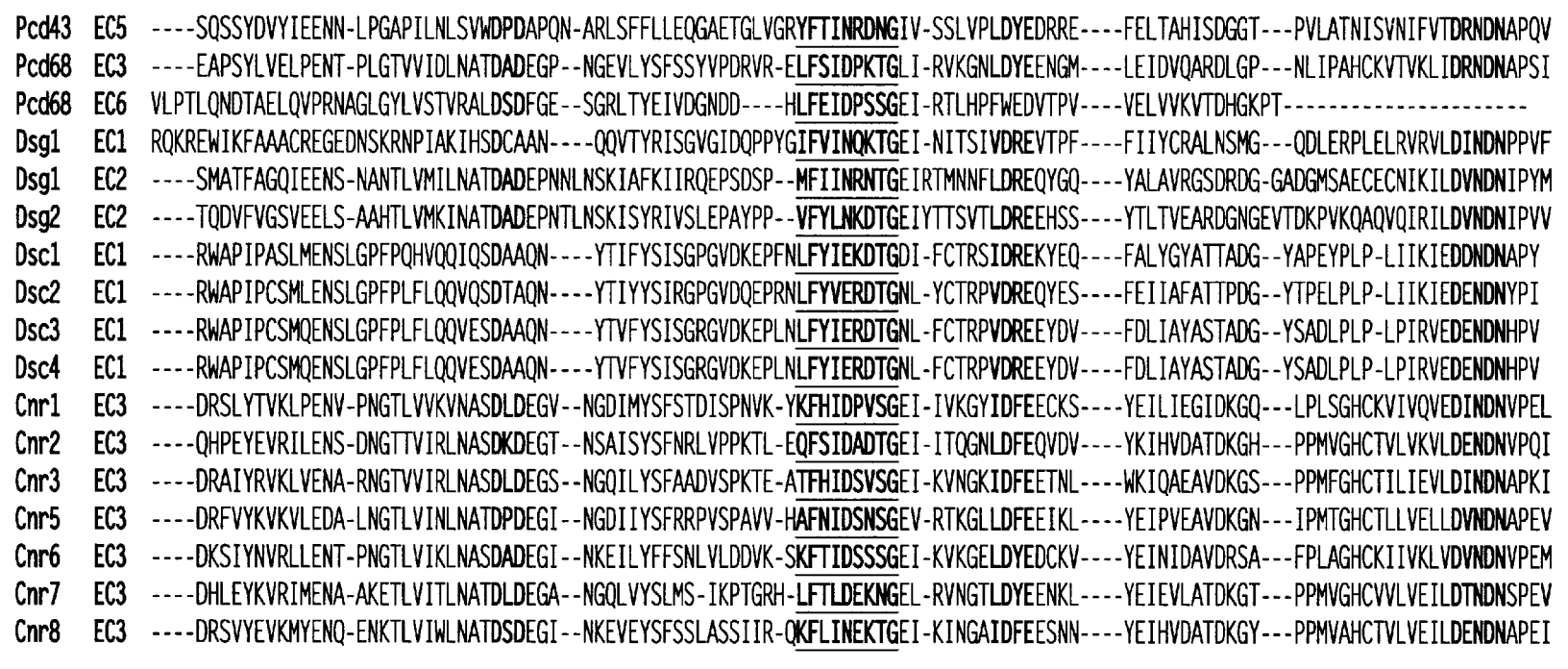

The term "nonclassical cadherin," as used herein, refers to a polypeptide that contains characteristic cadherin repeats, but does not contain an HAV CAR sequence. As used herein, a "cadherin repeat" refers to an amino acid sequence that is approximately 110 amino acid residues in length (generally 100 to 120 residues, preferably 105 to 115 residues), comprises an extracellular domain, and contains three calcium binding motifs (DXD, XDXE and DXXDX; SEQ ID NOS: 46 and 47 respectively) in the same order and in approximately the same position (see, e.g., FIG. 2). The presence of an extracellular domain may generally be determined using well known techniques, such as the presence of one or more of: a hydrophilic sequence, a region that is recognized by an antibody, a region that is cleaved by trypsin and/or a potential glycosylation site with the glycosylation motif Asn-X-Ser/Thr. The second calcium binding motif commonly has the sequence LDRE, although variants of this sequence with conservative substitutions are also observed, including MDRE (SEQ ID NO:65), LDFE (SEQ ID NO:66), LDYE (SEQ ID NO:67), IDRE (SEQ ID NO:68), VDRE (SEQ ID NO:69) and IDFE (SEQ ID NO:70). Within most cadherin repeats, the third calcium binding motif has the sequence [L,I,V]-X-[L,I,V]-X-D-X-N-D-[N,H]-X-P (SEQ ID NO:72), wherein residues indicated in brackets may be any one of the recited residues. A preferred third calcium binding motif has the sequence DXNDN (SEQ ID NO:1), although one or both of the D residues may be replaced by an E. Homology among cadherin repeats is generally at least 20%, preferably at least 30%, as determined by the ALIGN algorithm (Myers and Miller, *CABIOS* 4:11–17, 1988). Most cadherins comprise at least five cadherin repeats, along with a hydrophobic domain that transverses the plasma membrane and, optionally, one or more cytoplasmic domains, as shown in FIGS. 1B–1AA. Occasionally, however, a cadherin may substitute an extracellular domain that contains fewer than three calcium binding motifs for one or more of the cadherin repeats. For example, as shown in FIG. 2, the second extracellular domain of LI-cadherin comprises only the first calcium binding motif (DXD).

As noted above, atypical, or type II, cadherins include cadherin-5 (VE-cadherin), cadherin-6 (K-cadherin), cadherin-7, cadherin-8, cadherin-11 (OB-cadherin), cadherin-12, cadherin-14, cadherin-15 and PB-cadherin. Types III-X include LI-cadherin, T-cadherin, protocadherins (e.g., protocadherins 42, 43 and 68), desmocollins (e.g., desmocollins 1, 2, 3 and 4), desmogleins (e.g., desmogleins 1 and 2), and cadherin-related neuronal receptors. The sequence of various extracellular domains of each of these nonclassical cadherins is shown in FIG. 2, and SEQ ID NOs: 4–43.

A nonclassical cadherin CAR sequence, as used herein, is an amino acid sequence that is present within in a naturally occurring nonclassical cadherin and that is capable of detectably modulating a nonclassical cadherin-mediated function, such as cell adhesion, as described herein. In other words, contacting a nonclassical cadherin-expressing cell with a peptide comprising a CAR sequence results in a detectable change in a nonclassical cadherin-mediated fuiction using at least one of the representative assays provided herein. CAR sequences are generally recognized in vivo by a nonclassical cadherin or other adhesion molecule (ie., a molecule that mediates cell adhesion via a receptor on the cell surface), and are necessary for maximal heterophilic and/or homophilic interaction. CAR sequences may be of any length, but generally comprise at least three amino acid residues, preferably 4–16 amino acid residues, and more preferably 5–9 amino acid residues. A peptide modulating agent may comprise any number of amino acid residues, but preferred agents comprise 3–50 residues, preferably 4–16 residues.

It has been found, within the context of the present invention, that certain nonclassical cadherin CAR sequences share the consensus sequence:

Aaa-Phe-Baa-Ile/Leu/Val-Asp/Asn/Glu-Caa-Daa-Ser/Thr/Asn-Gly (SEQ ID NO:3)

Within the consensus sequence, Aaa, Baa, Caa and Daa indicate independently selected amino acid residues; "Ile/Leu/Val" indicates an amino acid that is isoleucine, leucine or valine; "Asp/Asn/Glu" indicates an amino acid that is aspartic acid, asparagine or glutamic acid; and "Ser/Thr/Asn" indicates an amino acid that is serine, threonine or asparagine. Representative nonclassical cadherin CAR sequences are provided within Table I. CAR sequences specifically provided herein further include portions of such representative CAR sequences, as well as longer polypeptides that comprise at least a portion of such sequences. Additional nonclassical cadherin CAR sequences may be identified based on sequence homology to the nonclassical cadherin CAR sequences provided herein, and based on the ability of a peptide comprising such a sequence to modulate a nonclassical cadherin-mediated function within a representative assay described herein. Within certain embodiments, a modulating agent comprises at least three consecutive residues, preferably at least five consecutive residues and more preferably at least seven consecutive residues, of a nonclassical cadherin CAR sequence that satisfies the above consensus sequence.

TABLE I

Representative Nonclassical Cadherin CAR Sequences

| Cadherin | CAR Sequence |
| --- | --- |
| HumanOB-cadherin EC1 | FFVIEEYTG (SEQ ID NO:99) |
| Human OB-cadherin EC1 | IFVIDDKSG (SEQ ID NO:85) |
| Human OB-cadherin EC2 | YFSVEAQTG (SEQ ID NO:113) |
| Human cadherin-5 EC1 | VFRVDAETG (SEQ ID NO:127) |
| Human cadherin-6 EC1 | FFLLEEYTG (SEQ ID NO:154) |
| Human cadherin-6 EC1 | LFIINENTG (SEQ ID NO:141) |
| Human cadherin-6 EC2 | YFSVESETG (SEQ ID NO:168) |
| Human cadherin-6 EC4 | IFNIDSGNG (SEQ ID NO:182) |
| Chicken cadherin-7 EC1 | IFIIDENTG (SEQ ID NO:196) |
| Chicken cadherin-7 EC2 | YFSVEPKTG (SEQ ID NO:210) |
| Chicken cadherin-7 EC4 | YFNIDANSG (SEQ ID NO:224) |
| Human cadherin-8 EC1 | MFVLEEESG (SEQ ID NO:252) |
| Human cadherin-8 EC1 | IFQINDVTG (SEQ ID NO:238) |
| Human cadherin-12 EC1 | VFTIDETTG (SEQ ID NO:266) |
| Human cadherin-12 EC2 | YFSIDPKTG (SEQ ID NO:280) |

TABLE I-continued

Representative Nonclassical Cadherin CAR Sequences

| Cadherin | CAR Sequence |
| --- | --- |
| Human cadherin-14 EC1 | IFIIDDTTG (SEQ ID NO:294) |
| Human cadherin-14 EC2 | YFSVDPKTG (SEQ ID NO:308) |
| Human cadherin-14 EC4 | FFNIDANTG (SEQ ID NO:319) |
| Human cadherin-15 EC1 | VFSIDKFTG (SEQ ID NO:333) |
| Human cadherin-15 EC2 | LFSIDELTG (SEQ ID NO:347) |
| Human T-cadherin EC1 | IFRINENTG (SEQ ID NO:361) |
| Rat PB-cadherin EC1 | FFVVEEYTG (SEQ ID NO:375) |
| Rat PB-cadherin EC1 | IFLIDELTG (SEQ ID NO:389) |
| Rat PB-cadherin EC2 | HFTVDPKTG (SEQ ID NO:403) |
| Rat PB-cadherin EC4 | IFDIDADTG (SEQ ID NO:417) |
| Human LI-cadherin EC2 | YFQINNKTG (SEQ ID NO:431) |
| Human protocadherin 43 EC3 | LFALDLVTG (SEQ ID NO:445) |
| Human protocadherin 43 EC5 | YFTINRDNG (SEQ ID NO:459) |
| Human protocadherin 68 EC3 | LFSIDPKTG (SEQ ID NO:473) |
| Human protocadherin 68 EC6 | LFEIDPSSG (SEQ ID NO:489) |
| Human desmoglein1 EC1 | IFVINQKTG (SEQ ID NO:503) |
| Human desmoglein1 EC2 | MFIINRNTG (SEQ ID NO:517) |
| Human desmoglein2 EC2 | VFYLNKDTG (SEQ ID NO:531) |
| Human desmocollin 1 EC1 | LFYIEKDTG (SEQ ID NO:545) |
| Human desmocollin 2 EC1 | LFYVERDTG (SEQ ID NO:559) |
| Human desmocollin 3/4 EC1 | LFYIERDTG (SEQ ID NO:571) |
| Mouse Cnr1 EC3 | KFHIDPVSG (SEQ ID NO:585) |
| Mouse Cnr2 EC3 | QFSIDADTG (SEQ ID NO:599) |
| Mouse Cnr3 EC3 | TFHIDSVSG (SEQ ID NO:613) |
| Mouse Cnr5 EC3 | AFNIDSNSG (SEQ ID NO:627) |
| Mouse Cnr6 EC3 | KFTIDSSSG (SEQ ID NO:641) |
| Mouse Cnr7 EC3 | LFTLDEKNG (SEQ ID NO:655) |
| Mouse Cnr8 EC3 | KFLINEKTG (SEQ ID NO:4052) |
| CONSENSUS | xFxidxxtG (SEQ ID NO:3) v n s l e n |

Nonclassical cadherin CAR sequences are generally physically located within the cadherin molecule in or near the binding site of an adhesion molecule (i.e., within 10 amino acids, and preferably within 5 amino acids). The location of a binding site may generally be determined using well known techniques, such as evaluating the ability of a portion of the nonclassical cadherin to bind to the same nonclassical cadherin or to another adhesion molecule. Any standard binding assay may be employed for such an evaluation. Recognition of a CAR sequence by the nonclassical cadherin or other adhesion molecule results in a measurable effect on an adhesion molecule function, such as cell adhesion. Peptides comprising a CAR sequence generally inhibit such a function unless linked, as described herein, to form an enhancer of adhesion molecule function.

Certain preferred nonclassical cadherin CAR sequences comprise 3–9 amino acid residues of a sequence provided in Table I. For example, a CAR sequence may comprise 3, 4 or 5 residues of a 9 amino acid sequence in Table I. For example, an OB cadherin CAR sequence generally comprises at least the sequence EEY, DDK or EAQ. Within certain embodiments, a CAR sequence may include at least residues 5–7 of a sequence in Table I.

Representative OB-cadherin CAR sequences comprise one or more of the peptide sequences DDK, IDDK (SEQ ID NO:4051) DDKS (SEQ ID NO:73), VIDDK (SEQ ID NO:74), IDDKS (SEQ ID NO:75), VIDDKS (SEQ ID NO:76), DDKSG (SEQ ID NO:77), IDDKSG (SEQ ID NO:78), VIDDKSG (SEQ ID NO:79), FVIDDK (SEQ ID NO:80), FVIDDKS (SEQ ID NO:81), FVIDDKSG (SEQ ID NO:82), IFVIDDK (SEQ ID NO:83), IFVIDDKS (SEQ ID NO:84), IFVIDDKSG (SEQ ID NO:85), EEY, IEEY (SEQ ID NO:86), EEYT (SEQ ID NO:87), VIEEY (SEQ ID NO:88), IEEYT (SEQ ID NO:89), VIEEYT (SEQ ID NO:90), EEYTG (SEQ ID NO:91), IEEYTG (SEQ ID NO:92), VIEEYTG (SEQ ID NO:93), FVIEEY (SEQ ID NO:94), FVIEEYT (SEQ ID NO:95), FVIEEYTG (SEQ ID NO:96), FFVIEEY (SEQ ID NO:97), FFVIEEYT (SEQ ID NO:98), FFVIEEYTG (SEQ ID NO:99), EAQ, VEAQ (SEQ ID NO:100), EAQT (SEQ ID NO:101), SVEAQ (SEQ ID NO:102), VEAQT (SEQ ID NO:103), SVEAQT (SEQ ID NO:104), EAQTG (SEQ ID NO:105), VEAQTG (SEQ ID NO:106), SVEAQTG (SEQ ID NO:107), FSVEAQ (SEQ ID NO:108), FSVEAQT (SEQ ID NO:109), FSVEAQTG (SEQ ID NO:110), YFSVEAQ (SEQ ID NO:111), YFSVEAQT (SEQ ID NO:112) or YFSVEAQTG (SEQ ID NO:113). Linear peptides having such sequences may be modified at the N- and/or C-termini, as in the peptides N-Ac-IFVIDDKSG-NH$_2$ (SEQ ID NO:85), N-Ac-FFVIEEYTG-NH$_2$ (SEQ ID NO:99) and N-Ac-YFSVEAQTG-NH$_2$ (SEQ ID NO:113).

Certain cadherin-5 CAR sequences comprise, for example, one or more of the peptide sequences: DAE, VDAE (SEQ ID NO:114), DAET (SEQ ID NO:115), RVDAE (SEQ ID NO:116), VDAET (SEQ ID NO:117), RVDAET (SEQ ID NO:118), DAETG (SEQ ID NO:119), VDAETG (SEQ ID NO:120), RVDAETG (SEQ ID NO:121), FRVDAE (SEQ ID NO:122), FRVDAET (SEQ ID NO:123), FRVDAETG (SEQ ID NO:124), VFRVDAE (SEQ ID NO:125), VFRVDAET (SEQ ID NO:126) or VFRVDAETG (SEQ ID NO:127). Linear peptides having such sequences may be modified at the N- and/or C-termini, as in the peptide N-Ac-VFRVDAETG-NH$_2$ (SEQ ID NO:127).

A cadherin-6 CAR sequence may comprise one or more of the sequences: NEN, INEN (SEQ ID NO128), NENT (SEQ ID NO:129), IINEN (SEQ ID NO:130), INENT (SEQ ID NO:131), IINENT (SEQ ID NO:132), NENTG (SEQ ID NO:133), INENTG (SEQ ID NO:134), IINENTG (SEQ ID NO:135), FIINEN (SEQ ID NO:136), FIINENT (SEQ ID NO:137), FIINENTG (SEQ ID NO:138), LFIINEN (SEQ ID NO:139), LFIINENT (SEQ ID NO:140), LFIINENTG (SEQ ID NO:141), EEY, EEYT (SEQ ID NO:142), EEYTG (SEQ ID NO:143), LEEY (SEQ ID NO:144), LEEYT (SEQ ID NO:145), LEEYTG (SEQ ID NO:146), LLEEY (SEQ ID NO:147), LLEEYTG (SEQ ID NO:148), FLLEEY (SEQ ID NO:149), FLLEEYT (SEQ ID NO:150), FLLEEYTG (SEQ ID NO:151), FFLLEEY (SEQ ID NO:152), FFLLEEYT (SEQ ID NO:153), FFLLEEYTG (SEQ ID NO:154), ESE, ESET (SEQ ID NO:155), ESETG (SEQ ID NO:156), VESE (SEQ ID NO:157), VSEST (SEQ ID NO:158), VESETG (SEQ ID NO:159), SVESE (SEQ ID NO:160), SVESET (SEQ ID NO:161), SVESETG (SEQ ID NO:162), FSVESE (SEQ ID NO:163), FSVESET (SEQ ID NO:164), FSVESETG (SEQ ID NO:165), YFSVESE (SEQ ID NO:166), YFSVESET (SEQ ID NO:167), YFSVESETG (SEQ ID NO:168), DSG, DSGN (SEQ ID NO:169), DSGNG (SEQ ID NO:170), IDSG (SEQ ID NO:171), IDSGN (SEQ ID NO:172), IDSGNG (SEQ ID NO:173), NIDSG (SEQ ID NO:174), NIDSGN (SEQ ID NO:175), NIDSGNG (SEQ ID NO:176), FNIDSG (SEQ ID NO:177), FNIDSGN (SEQ ID NO:178), FNIDSGNG (SEQ ID NO:179), IFNIDSG (SEQ ID NO:180), IFNIDSGN (SEQ ID NO:181) or IFNIDSGNG (SEQ ID NO:182). Linear peptides having such sequences may be modified at the N- and/or C-termini, as in the peptides N-Ac-FFLLEEYTG-NH$_2$ (SEQ ID NO:154), N-Ac-LFIINENTG-NH$_2$ (SEQ ID NO:141),N-Ac-YFSVESETG-NH$_2$ (SEQ ID NO:168) and N-Ac-IFNIDSGNG-NH$_2$ (SEQ ID NO:182).

A cadherin-7 CAR sequence may comprise, for example, one or more of the sequences: DEN, IDEN (SEQ ID NO:183), DENT (SEQ ID NO:184), IIDEN (SEQ ID NO:185), IDENT (SEQ ID NO:186), IIDENT (SEQ ID NO:187), DENTG (SEQ ID NO:188), IDENTG (SEQ ID NO:189), IIDENTG (SEQ ID NO:190), FIIDEN (SEQ ID NO:191), FIIDENT (SEQ ID NO:192), FIIDENTG (SEQ ID NO:193), IFIIDEN (SEQ ID NO:194), IFIIDENT (SEQ ID NO:195), IFIIDENTG (SEQ ID NO:196), EPK, EPKT (SEQ ID NO:197), EPKTG (SEQ ID NO:198), VEPK (SEQ ID NO:199), VEPKT (SEQ ID NO:200), VEPKTG (SEQ ID NO:201), SVEPK (SEQ ID NO:202), SVEPKT (SEQ ID NO:203), SVEPKTG (SEQ ID NO:204), FSVEPK (SEQ ID NO:205), FSVEPKT (SEQ ID NO:206), FSVEPKTG (SEQ ID NO:207), YFSVEPK (SEQ ID NO:208), YFSVEPKT (SEQ ID NO:209), YFSVEPKTG (SEQ ID NO:210), DAN, DANS (SEQ ID NO:211), DANSG (SEQ ID NO:212), IDAN (SEQ ID NO:213), IDANS (SEQ ID NO:214), IDANSG (SEQ ID NO:215), NIDAN (SEQ ID NO:216), NIDANS (SEQ ID NO:217), NIDANSG (SEQ ID NO:218), FNIDAN (SEQ ID NO:219), FNIDANS (SEQ ID NO:220), FNIDANSG (SEQ ID NO:221), YFNIDAN (SEQ ID NO:222), YFNIDANS (SEQ ID NO:223) or YFNIDANSG (SEQ ID NO:224). Linear peptides having such sequences may be modified at the N- and/or C-termini, as in the peptides N-Ac-IFIIDENTG-NH$_2$ (SEQ ID NO:196), N-Ac-YFSVEPKTG-NH$_2$ (SEQ ID NO:210) and N-Ac-YFNIDANSG-NH$_2$ (SEQ ID NO:224).

A cadherin-8 CAR sequence may comprise, for example, one or more of the sequences: NDV, INDV (SEQ ID NO:225), NDVT (SEQ ID NO:226), QINDV (SEQ ID NO:227), INDVT (SEQ ID NO:228), QINDVT (SEQ ID NO:229), NDVTG (SEQ ID NO:230), INDVTG (SEQ ID NO:231), QINDVTG (SEQ ID NO:232), FQINDV (SEQ ID NO:233), FQINDVT (SEQ ID NO:234), FQINDVTG (SEQ ID NO:235), IFQINDV (SEQ ID NO:236), IFQINDVT (SEQ ID NO:237), IFQINDVTG (SEQ ID NO:238), EEF, EEFS (SEQ ID NO:239), EEFSG (SEQ ID NO:240), LEEF (SEQ ID NO:241), LEEFS (SEQ ID NO:242), LEEFSG (SEQ ID NO:243), VLEEF (SEQ ID NO:244), VLEEFS (SEQ ID NO:245), VLEEFSG (SEQ ID NO:247), FVLEEF (SEQ ID NO:247), FVLEEFS (SEQ ID NO:248), FVLEEFSG (SEQ ID NO:249), MFVLEEF (SEQ ID NO:250), MFVLEEFS (SEQ ID NO:251) or MFVLEEFSG (SEQ ID NO:252). Linear peptides having such sequences may be modified at the N- and/or C-termini, as in the peptides N-Ac-MFVLEEFSG-NH$_2$ (SEQ ID NO:252) and N-Ac-IFQINDVTG-NH$_2$ (SEQ ID NO:238).

A cadherin-12 CAR sequence may comprise, for example, one or more of the sequences: DET, IDET (SEQ ID NO:253), DETT (SEQ ID NO:254), TIDET (SEQ ID NO:255), IDETT (SEQ ID NO:256), TIDETT (SEQ ID NO:257), DETTG (SEQ ID NO:258), IDETTG (SEQ ID NO:259), TIDETTG (SEQ ID NO:260), FTIDET (SEQ ID NO:261), FTIDETT (SEQ ID NO:262), FTIDETTG (SEQ ID NO:263), VFTIDET (SEQ ID NO:264), VFTIDETT (SEQ ID NO:265), VFTIDETTG (SEQ ID NO:266), DPK, DPKT (SEQ ID NO:267), DPKTG (SEQ ID NO:268), IDPK (SEQ ID NO:269), IDPKT (SEQ ID NO:270), IDPKTG (SEQ ID NO:271), SIDPK (SEQ ID NO:272), SIDPKT (SEQ ID NO:273), SIDPKTG (SEQ ID NO:274), FSIDPK (SEQ ID NO:275), FSIDPKT (SEQ ID NO:276), FSIDPKTG (SEQ ID NO:277), YFSIDPK (SEQ ID NO:278), YFSIDPKT (SEQ ID NO:279) or YFSIDPKTG (SEQ ID NO:280). Linear peptides having such sequences may be modified at the N- and/or C-termini, as in the peptides N-Ac-VFTIDETTG-NH$_2$ (SEQ ID NO:266) and N-Ac-YFSIDPKTG-NH$_2$ (SEQ ID NO:280).

A cadherin-14 CAR sequence may comprise, for example, one or more of the sequences: DDT, IDDT (SEQ ID NO:281), DDTT (SEQ ID NO:282), IIDDT (SEQ ID NO:283), IDDTT (SEQ ID NO:284), IIDDTT (SEQ ID NO:285), DDTTG (SEQ ID NO:286), IDDTTG (SEQ ID NO:287), IIDDTTG (SEQ ID NO:288), FIIDDT (SEQ ID NO:289), FIIDDTT (SEQ ID NO:290), FIIDDTTG (SEQ ID NO:291), IFIIDDT (SEQ ID NO:292), IFIIDDTT (SEQ ID NO:293), IFIIDDTTG (SEQ ID NO:294), DPK, DPKT (SEQ ID NO:295), DPKTG (SEQ ID NO:296), VDPK (SEQ ID NO:297), VDPKT (SEQ ID NO:298), VDPKTG (SEQ ID NO:299), SVDPK (SEQ ID NO:300), SVDPKT (SEQ ID NO:301), SVDPKTG (SEQ ID NO:302), FSVDPK (SEQ ID NO:303), FSVDPKT (SEQ ID NO:304), FSVDPKTG (SEQ ID NO:305), YFSVDPK (SEQ ID NO:306), YFSVDPKT (SEQ ID NO:307), YFSVDPKTG (SEQ ID NO:308), DAN, DANT (SEQ ID NO:309), DANTG (SEQ ID NO:310), IDANT (SEQ ID NO:311), IDANTG (SEQ ID NO:312), NIDANT (SEQ ID NO:313), NIDANTG (SEQ ID NO:314), FNIDANT (SEQ ID NO:315), FNIDANTG (SEQ ID NO:316), FFNIDAN (SEQ ID NO:317), FFNIDANT (SEQ ID NO:318) or FFNIDANTG (SEQ ID NO:319). Linear peptides having such sequences may be modified at the N- and/or C-termini, as in the peptides N-Ac-IFIIDDTTG-NH$_2$ (SEQ ID NO:294), N-Ac-YFSVDPKTG-NH$_2$ (SEQ ID NO:308) and N-Ac-FFNIDANTG-NH$_2$ (SEQ ID NO:319).

A cadherin-15 CAR sequence may comprise, for example, one or more of the sequences: DKF, IDKF (SEQ ID NO:320), DKFT (SEQ ID NO:321), SIDKF (SEQ ID NO:322), IDKFT (SEQ ID NO:323), SIDKFT (SEQ ID NO:324), DKFTG (SEQ ID NO:325), IDKFTG (SEQ ID NO:326), SIDKFTG (SEQ ID NO:327), FSIDKF (SEQ ID NO:328), FSIDKFT (SEQ ID NO:329), FSIDKFTG (SEQ ID NO:330), VFSIDKF (SEQ ID NO:331), VFSIDKFT (SEQ ID NO:332), VFSIDKFTG (SEQ ID NO:333), DEL, DELT (SEQ ID NO:334), DELTG (SEQ ID NO:335), IDEL (SEQ ID NO:336), IDELT (SEQ ID NO:337), IDELTG (SEQ ID NO:338), SIDEL (SEQ ID NO:339), SIDELT (SEQ ID NO:340), SIDELTG (SEQ ID NO:341), FSIDEL (SEQ ID NO:342), FSIDELT (SEQ ID NO:343), FSIDELTG (SEQ ID NO:344), LFSIDEL (SEQ ID NO:345), LFSIDELT (SEQ ID NO:346) or LFSIDELTG (SEQ ID NO:347). Linear peptides having such sequences may be modified at the N- and/or C-termini, as in the peptides N-Ac-VFSIDKFTG-NH$_2$ (SEQ ID NO:333) and N-Ac-LFSIDELTG-NH$_2$ (SEQ ID NO:347).

A T-cadherin CAR sequence may comprise, for example, one or more of the sequences: NEN, INEN (SEQ ID NO:348), NENT (SEQ ID NO:349), RINEN (SEQ ID NO:350), INENT (SEQ ID NO:351), RINENT (SEQ ID NO:352), NENTG (SEQ ID NO:353), INENTG (SEQ ID NO:354), RINENTG (SEQ ID NO:355), FRINEN (SEQ ID NO:356), FRINENT (SEQ ID NO:357), FRINENTG (SEQ ID NO:358), IFRINEN (SEQ ID NO:359), IFRINENT (SEQ ID NO:360) or IFRINENTG (SEQ ID NO:361). Linear peptides having such sequences may be modified at the N- and/or C-termini, as in the peptide N-Ac-IFRINENTG-NH$_2$ (SEQ ID NO:361).

A PB-cadherin CAR sequence may comprise, for example, one or more of the sequences: EEY, EEYT (SEQ ID NO:362), EEYTG (SEQ ID NO:363), VEEY (SEQ ID NO:364), VEEYT (SEQ ID NO:365), VEEYTG (SEQ ID NO:366), VVEEY (SEQ ID NO:367), VVEEYT (SEQ ID NO:368), VVEEYTG (SEQ ID NO:369), FVVEEY (SEQ ID NO:370), FVEEYT (SEQ ID NO:371), FVEEYTG (SEQ ID NO:372), FFVVEEY (SEQ ID NO:373), FFVVEEYT (SEQ ID NO:374), FFVVEEYTG (SEQ ID NO:375), DEL, DELT (SEQ ID NO:376), DELTG (SEQ ID NO:377), IDEL (SEQ ID NO:378), IDELT (SEQ ID NO:379), IDELTG (SEQ ID NO:380), LIDEL (SEQ ID NO:381), LIDELT (SEQ ID NO:382), LIDELTG (SEQ ID NO:383), FLIDEL (SEQ ID NO:384), FLIDELT (SEQ ID NO:385), FLIDELTG (SEQ ID NO:386), IFLIDEL (SEQ ID NO:387), IFLIDELT (SEQ ID NO:388), IFLIDELTG (SEQ ID NO:389), DPK, DPKT (SEQ ID NO:390), DPKTG (SEQ ID NO:391), VDPK (SEQ ID NO:392), VDPKT (SEQ ID NO:393), VDPKTG (SEQ ID NO:394), TVDPK (SEQ ID NO:395), TVDPKT (SEQ ID NO:396), TVDPKTG (SEQ ID NO:397), FTVDPK (SEQ ID NO:398), FTVDPKT (SEQ ID NO:399), FTVDPKTG (SEQ ID NO:400), HFTVDPK (SEQ ID NO:401), HFTVDPKT (SEQ ID NO:402), HFTVDPKTG (SEQ ID NO:403), DAD, DADT (SEQ ID NO:404), DADTG (SEQ ID NO:405), IDAD (SEQ ID NO:406), IDADT (SEQ ID NO:407), IDADTG (SEQ ID NO:408), DIDAD (SEQ ID NO:409), DIDADT (SEQ ID NO:410), DIDADTG (SEQ ID NO:411), FDIDAD (SEQ ID NO:412), FDIDADT (SEQ ID NO:413), FDIDADTG (SEQ ID NO:414), IFDIDAD (SEQ ID NO:415), IFDIDADT (SEQ ID NO:416) and IFDIDADTG (SEQ ID NO:417). Linear peptides having such sequences may be modified at the N- and/or C-ternini, as in the peptides N-Ac-FFVVEEYTG-NH$_2$ (SEQ ID NO:375), N-Ac-IFLIDELTG-NH$_2$ (SEQ ID NO:389), N-Ac-HFTVDPKTG-NH$_2$ (SEQ ID NO:403) and N-Ac-IFDIDADTG-NH$_2$ (SEQ ID NO:417).

A LI-cadherin CAR sequence may comprise, for example, one or more of the sequences: NNK, NNKT (SEQ ID NO:418), NNKTG (SEQ ID NO:419), INNK (SEQ ID NO:420), INNKT (SEQ ID NO:421), INNKTG (SEQ ID NO:422), QINNK (SEQ ID NO:423), QINNKT (SEQ ID NO:424), QINNKTG (SEQ ID NO:425), FQINNK (SEQ ID NO:426), FQINNKT (SEQ ID NO:427), FQINNKTG (SEQ ID NO:428), YFQINNK (SEQ ID NO:429), YFQINNKT (SEQ ID NO:430) or YFQINNKTG (SEQ ID NO:431). Linear peptides having such sequences may be modified at the N- and/or C-termini, as in the peptide N-Ac-YFQINNKTG-NH$_2$ (SEQ ID NO:431).

A protocadherin CAR sequence may comprise, for example, one or more of the sequences: DLV, DLVT (SEQ ID NO:432), DLVTG (SEQ ID NO:433), LDLV (SEQ ID NO:434), LDLVT (SEQ ID NO:435), LDLVTG (SEQ ID NO:436), ALDLV (SEQ ID NO:437), ALDLVT (SEQ ID NO:438), ALDLVTG (SEQ ID NO:439), FALDLV (SEQ ID NO:440), FALDLVT (SEQ ID NO:441), FALDLVTG (SEQ ID NO:442), LFALDLV (SEQ ID NO:443), LFALDLVT (SEQ ID NO:444), LFALDLVTG (SEQ ID NO:445), NRD, NRDN (SEQ ID NO:446), NRDNG (SEQ ID NO:447), INRD (SEQ ID NO:448), INRDN (SEQ ID NO:449), INRDNG (SEQ ID NO:450), TINRD (SEQ ID NO:451), TINRDN (SEQ ID NO:452), TINRDNG (SEQ ID NO:453), FTINRD (SEQ ID NO:454), FTINRDN (SEQ ID NO:455), FTINRDNG (SEQ ID NO:456), YFTINRD (SEQ ID NO:457), YFTINRDN (SEQ ID NO:458), YFTINRDNG (SEQ ID NO:459), DPK, DPKT (SEQ ID NO:460), DPKTG (SEQ ID NO:461), IDPK (SEQ ID NO:462), IDPKT (SEQ ID NO:463), IDPKTG (SEQ ID NO:464), SIDPK (SEQ ID NO:465), SIDPKT (SEQ ID NO:466), SIDPKTG (SEQ ID NO:467), FSIDPK (SEQ ID NO:468), FSIDPKT (SEQ ID NO:469), FSIDPKTG (SEQ ID NO:470), LFSIDPK (SEQ ID NO:471), LFSIDPKT (SEQ ID NO:472), LFSIDPKTG (SEQ ID NO:473), DPS, DPSS (SEQ ID NO:474), DPSSG (SEQ ID NO:475), IDPS (SEQ ID NO:476), IDPSS (SEQ ID NO:477), IDPSSG (SEQ ID NO:478), EIDPS (SEQ ID NO:479), EIDPSS (SEQ ID NO:480), EIDPSSG (SEQ ID NO:481), FEIDPS (SEQ ID NO:482), FEIDPSS (SEQ ID NO:483), FEIDPS (SEQ ID NO:484), FEIDPSS (SEQ ID NO:485), FEIDPSSG (SEQ ID NO:486), LFEIDPS (SEQ ID NO:487), LFEIDPSS (SEQ ID NO:488) or LFEIDPSSG (SEQ ID NO:489). Linear peptides having such sequences may be modified at the N- and/or C-termini, as in the peptides N-Ac-LFALDLVTG-NH$_2$ (SEQ ID NO:445), N-Ac-YFTINRDNG-NH$_2$ (SEQ ID NO:459), N-Ac-LFSIDPKTG-NH$_2$ (SEQ ID NO:473) and N-Ac-LFEIDPSSG-NH$_2$ (SEQ ID NO:489).

A desmoglein CAR sequence may comprise, for example, one or more of the sequences: NQK, NQKT (SEQ ID NO:490), NQKTG (SEQ ID NO:491), INQK (SEQ ID NO:492), INQKT (SEQ ID NO:493), INQKTG (SEQ ID NO:494), VINQK (SEQ ID NO:495), VINQKT (SEQ ID NO:496), VINQKTG (SEQ ID NO:497), FVINQK (SEQ ID NO:498), FVINQKT (SEQ ID NO:499), FVINQKTG (SEQ ID NO:500), IFVINQK (SEQ ID NO:501), IFVINQKT (SEQ ID NO:502), IFVINQKTG (SEQ ID NO:503), NRN, NRNT (SEQ ID NO:504), NRNTG (SEQ ID NO:505), INRN (SEQ ID NO:506), INRNT (SEQ ID NO:507), INRNTG (SEQ ID NO:508), IINRN (SEQ ID NO:509), IINRNT (SEQ ID NO:510), IINRNTG (SEQ ID NO:511), FIINRN (SEQ ID NO:512), FIINRNT (SEQ ID NO:513), FIINRNTG (SEQ ID NO:514), MFIINRN (SEQ ID NO:515), MFIINRNT (SEQ ID NO:516), MFIINRNTG (SEQ ID NO:517), NKD, NKDT (SEQ ID NO:518), NKDTG (SEQ ID NO:519), LNKD (SEQ ID NO:520), LNKDT (SEQ ID NO:521), LNKDTG (SEQ ID NO:522), YLNKD (SEQ ID NO:523), YLNKDT (SEQ ID NO:524), YLNKDTG (SEQ ID NO:525), FYLNKD (SEQ ID NO:526), FYLNKDT (SEQ ID NO:527), FYLNKDTG (SEQ ID NO:528), VFYLNKD (SEQ ID NO:529), VFYLNKDT (SEQ ID NO:530) or VFYLNKDTG (SEQ ID NO:531). Linear peptides having such sequences may be modified at the N- and/or C-termini, as in the peptides N-Ac-IFVINQKTG-NH$_2$ (SEQ ID NO:503), N-Ac-MFIINRNTG-NH$_2$ (SEQ ID NO:517) and N-Ac-VFYLNKDTG-NH$_2$ (SEQ ID NO:531).

A desmocollin CAR sequence may comprise, for example, one or more of the sequences EKD, EKDT (SEQ ID NO:532), EKDTG (SEQ ID NO:533), IEKD (SEQ ID NO:534), IEKDT (SEQ ID NO:535), IEKDTG (SEQ ID NO:536), YIEKD (SEQ ID NO:537), YIEKDT (SEQ ID NO:538), YIEKDTG (SEQ ID NO:539), FYIEKD (SEQ ID NO:540), FYIEKDT (SEQ ID NO:541), FYIEKDTG (SEQ ID NO:542), LFYIEKD (SEQ ID NO:543), LFYIEKDT (SEQ ID NO:544), LFYIEKDTG (SEQ ID NO:545), ERD, ERDT (SEQ ID NO:546), ERDTG (SEQ ID NO:547), VERD (SEQ ID NO:548), VERDT (SEQ ID NO:549), VERDTG (SEQ ID NO:550), YVERD (SEQ ID NO:551), YVERDT (SEQ ID NO:552), YVERDTG (SEQ ID NO:553), FYVERD (SEQ ID NO:554), FYVERDT (SEQ ID NO:555), FYVERDTG (SEQ ID NO:556), LFYVERD (SEQ ID NO:557), LFYVERDT (SEQ ID NO:558), LFYVERDTG (SEQ ID NO:559), IERD (SEQ ID NO:560), IERDT (SEQ ID NO:561), IERDTG (SEQ ID NO:562), YIERD (SEQ ID NO:563), YIERDT (SEQ ID NO:564), YIERDTG (SEQ ID NO:565), FYIERD (SEQ ID NO:566), FYIERDT (SEQ ID NO:567), FYIERDTG (SEQ ID NO:568), LFYIERD (SEQ ID NO:569), LFYIERDT (SEQ ID NO:570) or LFYIERDTG (SEQ ID NO:571). Linear peptides having such sequences may be modified at the N- and/or C-termini, as in the peptides N-Ac-LFYIEKDTG-NH$_2$ (SEQ ID NO:545), N-Ac-LFYVERDTG-NH$_2$ (SEQ ID NO:559) and N-Ac-LFYIERDTG-NH$_2$ (SEQ ID NO:571).

A cadherin-related neuronal receptor (cnr) CAR sequence may comprise, for example, one or more of the sequences: DPV, DPVS (SEQ ID NO:572), DPVSG (SEQ ID NO:573), IDPV (SEQ ID NO:574), IDPVS (SEQ ID NO:575), IDPVSG (SEQ ID NO:576), HIDPV (SEQ ID NO:577), HIDPVS (SEQ ID NO:578), HIDPVSG (SEQ ID NO:579), FHIDPV (SEQ ID NO:580), FHIDPVS (SEQ ID NO:581), FHIDPVSG (SEQ ID NO:582), KFHIDPV (SEQ ID NO:583), KFHIDPVS (SEQ ID NO:584), KFHIDPVSG (SEQ ID NO:585), DAD, DADT (SEQ ID NO:586), DADTG (SEQ ID NO:587), IDAD (SEQ ID NO:588), IDADT (SEQ ID NO:589), IDADTG (SEQ ID NO:590), SIDAD (SEQ ID NO:591), SIDADT (SEQ ID NO:592), SIDADTG (SEQ ID NO:593), FSIDAD (SEQ ID NO:594), FSIDADT (SEQ ID NO:595), FSIDADTG (SEQ ID NO:596), QFSIDAD (SEQ ID NO:597), QFSIDADT (SEQ ID NO:598), QFSIDADTG (SEQ ID NO:599), DSV, DSVS (SEQ ID NO:600), DSVSG (SEQ ID NO:601), IDSV (SEQ ID NO:602), IDSVS (SEQ ID NO:603), IDSVSG (SEQ ID NO:604), HIDSV (SEQ ID NO:605), HIDSVS (SEQ ID NO:606), HIDSVSG (SEQ ID NO:607), FHIDSV (SEQ ID NO:608), FHIDSVS (SEQ ID NO:609), FHIDSVSG (SEQ ID NO:610), TFHIDSV (SEQ ID NO:611), TFHIDSVS (SEQ ID NO:612), TFHIDSVSG (SEQ ID NO:613), DSN, DSNS (SEQ ID NO:614), DSNSG (SEQ ID NO:615), IDSN (SEQ ID NO:616), IDSNS (SEQ ID NO:617), IDSNSG (SEQ ID NO:618), NIDSN (SEQ ID NO:619), NIDSNS (SEQ ID NO:620), NIDSNSG (SEQ ID NO:621), FNIDSN (SEQ ID NO:622), FNIDSNS (SEQ ID NO:623), FNIDSNSG (SEQ ID NO:624), AFNIDSN (SEQ ID NO:625), AFNIDSNS (SEQ ID NO:626), AFNIDSNSG (SEQ ID NO:627), DSS, DSSS (SEQ ID NO:628), DSSSG (SEQ ID NO:629), IDSS (SEQ ID NO:630), IDSSS (SEQ ID NO:631), IDSSSG (SEQ ID NO:632), TIDSS (SEQ ID NO:633), TIDSSS (SEQ ID NO:634), TIDSSSG (SIQ ID NO:635), FTIDSS (SEQ ID NO:636), FTIDSSS (SEQ ID NO:637), FTIDSSSG (SEQ ID NO:638), KFTIDSS (SEQ ID NO:639), KFTIDSSS (SEQ ID NO:640), KFTIDSSSG (SEQ ID NO:641), DEK, DEKN (SEQ ID NO:642), DEKNG (SEQ ID NO:643), LDEK (SEQ ID NO:644), LDEKN (SEQ ID NO:645), LDEKNG (SEQ ID NO:646), TLDEK (SEQ ID NO:647), TLDEKN (SEQ ID NO:648), TLDEKNG (SEQ ID NO:649), FTLDEK (SEQ ID NO:650), FTLDEKN (SEQ ID NO:651), FTLDEKNG (SEQ ID NO:652), LFTLDEK (SEQ ID NO:653), LFTLDEKN (SEQ ID NO:654), LFTLDEKNG (SEQ ID NO:655), NEK, NEKT (SEQ ID NO:656), NEKTG (SEQ ID NO:657), INEK (SEQ ID NO:658), INEKT (SEQ ID NO:659), INEKTG (SEQ ID NO:660), LINEK (SEQ ID NO:661), LINEKT (SEQ ID NO:662), LINEKTG (SEQ ID NO:663), FLINEK (SEQ ID NO:664), FLINEKT (SEQ ID NO:665), FLINEKTG (SEQ ID NO:666), KFLINEK (SEQ ID NO:667), KFLINEKT (SEQ ID NO:668) or KFLINEKTG (SEQ ID NO:4052). Linear peptides having such sequences may be modified at the N- and/or C-termini, as in the peptides N-Ac-KFHIDPVSG-NH$_2$ (SEQ ID NO:585), N-Ac-QFSIDADTG-NH$_2$ (SEQ ID NO:599), N-Ac-TFHIDSVSG-NH$_2$ (SEQ ID NO:613), N-Ac-AFNIDSNSG-NH$_2$ (SEQ ID NO:627), N-Ac-KFTIDSSG-NH$_2$ (SEQ ID NO:641), N-Ac-LFTLDEKNG-NH$_2$ (SEQ ID NO:655) and N-Ac-KFLINEKTG-NH$_2$ (SEQ ID NO:4052).

Those of ordinary skill in the art will recognize that similar peptide sequences may be designed to modulate a function mediated by other cadherins, following identification of a CAR sequence as described herein.

It will be apparent that certain of the peptide sequences provided above may modulate a function mediated by multiple nonclassical cadherins. In general, peptides comprising a greater number of consecutive residues derived from a particular nonclassical cadherin have a greater specificity for that cadherin. In addition, further flanking sequences may be included to enhance specificity. Such flanking sequences may be identified based on the sequences provided in FIG. 2, or based on published sequences. To achieve specificity (i.e., modulation of a particular nonclassical cadherin function that is enhanced relative to the modulation of a function mediated by a different cadherin), the addition of 2 to 5 flanking residues (preferably at least one residue on either side of the CAR sequence) is generally sufficient. Specificity may be evaluated using assays for the ability to inhibit functions mediated by particular cadherins, as described herein.

As noted above, modulating agents as described herein may comprise an analogue or mimetic of a nonclassical cadherin CAR sequence. An analogue generally retains at least 50% identity to a native nonclassical cadherin CAR sequence, and modulates a nonclassical cadherin-mediated function as described herein. Such analogues preferably contain at least three consecutive residues of, and more preferably at least five consecutive residues of, a nonclassical cadherin CAR sequence. An analogue may contain any of a variety of amino acid substitutions, additions, deletions and/or modifications (e.g., side chain modifications). Preferred amino acid substitutions are conservative. A "conservative substitution" is one in which an amino acid is substituted for another amino acid that has similar properties, such that one skilled in the art of peptide chemistry would expect the secondary structure and hydropathic nature of the polypeptide to be substantially unchanged. Amino acid substitutions may generally be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. The critical determining feature of a nonclassical cadherin CAR sequence analogue is the ability to modulate a nonclassical cadherin-mediated function, which may be evaluated using the representative assays provided herein.

A mimetic is a non-peptidyl compound that is conformationally similar to a nonclassical cadherin CAR sequence, such that it modulates a nonclassical cadherin-mediated function as described below. Such mimetics may be designed based on techniques that evaluate the three dimensional structure of the peptide. For example, Nuclear Magnetic Resonance spectroscopy (NMR) and computational techniques may be used to determine the conformation of a nonclassical cadherin CAR sequence. NMR is widely used for structural analyses of both peptidyl and non-peptidyl compounds. Nuclear Overhauser Enhancements (NOE's), coupling constants and chemical shifts depend on the conformation of a compound. NOE data provides the interproton distance between protons through space and can be used to calculate the lowest energy conformation for the nonclassical cadherin CAR sequence. This information can then be used to design mimetics of the preferred conformation. Linear peptides in solution exist in many conformations. By using conformational restriction techniques it is possible to fix the peptide in the active conformation. Conformational restriction can be achieved by i) introduction of an alkyl group such as a methyl which sterically restricts free bond rotation; ii) introduction of unsaturation which fixes the relative positions of the terminal and geminal substituents; and/or iii) cyclization, which fixes the relative positions of the sidechains. Mimetics may be synthesized where one or more of the amide linkages has been replaced by isosteres, substituents or groups which have the same size or volume such as $-CH_2NH-$, $-CSNH-$, $-CH_2S-$, $-CH=CH-$, $-CH_2CH_2-$, $-CONMe-$ and others. These backbone amide linkages can also be part of a ring structure (e.g., lactam). Mimetics may be designed where one or more of the side chain functionalities of the nonclassical cadherin CAR sequence are replaced by groups that do not necessarily have the same size or volume, but have similar chemical and/or physical properties which produce similar biological responses. Other mimetics may be small molecule mimics, which may be readily identified from small molecule libraries, based on the three-dimensional structure of the CAR sequence. It should be understood that, within embodiments described below, an analogue or mimetic may be substituted for a nonclassical cadherin CAR sequence.

Modulating agents, or peptide portions thereof, may be linear or cyclic peptides. The term "cyclic peptide," as used herein, refers to a peptide or salt thereof that comprises (1) an intramolecular covalent bond between two non-adjacent residues and (2) at least one nonclassical cadherin CAR sequence or an analogue thereof. The intramolecular bond may be a backbone to backbone, side-chain to backbone or side-chain to side-chain bond (i.e., terminal functional groups of a linear peptide and/or side chain functional groups of a terminal or interior residue may be linked to achieve cyclization). Preferred intramolecular bonds include, but are not limited to, disulfide, amide and thioether bonds. One or more of any of the above nonclassical cadherin CAR sequences, or an analogue or mimetic thereof, may be incorporated into a cyclic peptide, with or without one or more other adhesion molecule binding sites. Additional adhesion molecule binding sites are described in greater detail below.

The size of a cyclic peptide ring generally ranges from 5 to about 15 residues, preferably from 5 to 10 residues. Additional residue(s) may be present on the N-terminal and/or C-terminal side of a nonclassical cadherin CAR sequence, and may be derived from sequences that flank a nonclassical cadherin CAR sequence, with or without amino acid substitutions and/or other modifications. Alternatively, additional residues present on one or both sides of the CAR sequence(s) may be unrelated to an endogenous sequence (e.g., residues that facilitate cyclization, purification or other manipulation and/or residues having a targeting or other function).

Within certain embodiments, a modulating agent may comprise a cyclic peptide that contains a nonclassical cadherin CAR sequence as provided in Table I (or a portion of such a CAR sequence). Certain cyclic peptides have the formula:

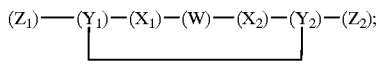

Within this formula, W is a tripeptide selected from the group consisting of EEY, DDK, EAQ, DAE, NEN, ESE, DSG, DEN, EPK, DAN, EEF, NDV, DET, DPK, DDT, DAN, DKF, DEL, DAD, NNK, DLV, NRD, DPS, NQK, NRN, NKD, EKD, ERD, DPV, DSV, DLY, DSN, DSS, DEK and NEK; $X_1$, and $X_2$ are optional, and if present, are independently selected from the group consisting of amino acid residues and combinations thereof in which the residues are linked by peptide bonds, and wherein $X_1$ and $X_2$ independently range in size from 0 to 10 residues, such that the sum of residues contained within $X_1$ and $X_2$ ranges from 1 to 12; $Y_1$ and $Y_2$ are independently selected from the group consisting of amino acid residues, and wherein a covalent bond is formed between residues $Y_1$ and $Y_2$; and $Z_1$ and $Z_2$ are optional, and if present, are independently selected from the group consisting of amino acid residues and combinations thereof in which the residues are linked by peptide bonds.

Cyclic peptides may comprise any of the above CAR sequence(s). Such cyclic peptides may be used as modulating agents without modification, or may be For example, cyclic peptides may comprise any of the above OB-cadherin CAR sequence(s). Representative cyclic peptides include CDDKC (SEQ ID NO669), CIDDKC (SEQ ID NO:670), CDDKSC (SEQ ID NO:671), CVIDDKC (SEQ ID NO:672), CIDDKSC (SEQ ID NO:673), CVIDDKSC (SEQ ID NO:674), CDDKSGC (SEQ ID NO:675), CIDDKSGC (SEQ ID NO:676), CVIDDKSGC (SEQ ID NO:677), CFVIDDKC (SEQ ID NO:678), CFVIDDKSC (SEQ ID NO:679), CFVIDDKSGC (SEQ ID NO:680), CIFVIDDKC (SEQ ID NO:681), CIFVIDDKSC (SEQ ID NO:682), CIFVIDDKSGC (SEQ ID NO:683), DDDKK (SEQ ID NO:684), DIDDKK (SEQ ID NO:685), DVIDDKK (SEQ ID NO:686), DFVIDDKK (SEQ ID NO:687), DIFVIDDKK (SEQ ID NO:688), EDDKK (SEQ ID NO:689), EIDDKK (SEQ ID NO:690), EVIDDKK (SEQ ID NO:691), EFVIDDKK (SEQ ID NO:692), EIFVIDDKK (SEQ ID NO:693), FVIDDK (SEQ ID NO:694), FVIDDKS (SEQ ID NO:695), FVIDDKSG (SEQ ID NO:696), KDDKD (SEQ ID NO:697), KIDDKD (SEQ ID NO:698), KDDKSD (SEQ ID NO:699), KVIDDKD (SEQ ID NO:700), KIDDKSD (SEQ ID NO:701), KVIDDKSD (SEQ ID NO:702), KDDKSGD (SEQ ID NO):703), KIDDKSGD (SEQ ID NO:704), KVIDDKSGD (SEQ ID NO:705), KFVIDDKID (SEQ ID NO:706), KFVIDDKSD (SEQ ID NO:707), KFVIDDKSGD (SEQ ID NO:708), KIFVIDDKD (SEQ ID NO:709), KIFVIDDKSD (SEQ ID NO:710), KIFVIDDKSGD (SEQ ID NO:711), VIDDK (SEQ ID NO:712), IDDKS (SEQ ID NO:713), VIDDKS (SEQ ID NO:714), VIDDKSG (SEQ ID NO:715), DDKSG (SEQ ID NO:716), IDDKSG (SEQ ID NO:717), IFVIDDK (SEQ ID NO:718), IFVIDDKS (SEQ ID NO:719), IFVIDDKSG (SEQ ID NO:720), KDDKE (SEQ ID NO:721), KIDDKE (SEQ ID NO:722), KDDKSE (SEQ ID NO:723), KVIDDKE (SEQ ID NO:724), KIDDKSE (SEQ ID NO:725), KVIDDKSE (SEQ ID NO:726), KDDKSGE (SEQ ID NO:727), KIDDKSGE (SEQ ID NO:728), KVIDDKSGE (SEQ ID NO:729), KFVIDDKE (SEQ ID NO:730), KFVIDDKSE (SEQ ID NO:731), KFVIDDKSGE (SEQ ID NO:732), KIFVIDDKE (SEQ ID NO:733), KIFVIDDKSE (SEQ ID NO:734), KIFVIDDKSGE (SEQ ID NO:735), CEEYC (SEQ ID NO:736), CIEEYC (SEQ ID NO:737), CEEYTC (SEQ ID NO:738), CVIEEYC (SEQ ID NO:739), CIEEYTC (SEQ ID NO:740), CVIEEYTC (SEQ ID NO:741), CEEYTGC (SEQ ID NO:742), CIEEYTGC (SEQ ID NO:743), CVIEEYTGC (SEQ ID NO:744), CFVIEEYC (SEQ ID NO:745), CFVIEEYTC (SEQ ID NO:746), CFVIEEYTGC (SEQ ID NO:747), CFFVIEEYC (SEQ ID NO:748), CFFVIEEYTC (SEQ ID NO:749), CFFVIEEYTGC (SEQ ID NO:750), KEEYD (SEQ ID NO:751), KIEEYD (SEQ ID NO:752), KEEYTD (SEQ ID NO:753), KVIEEYD (SEQ ID NO:754), KIEEYTD (SEQ ID NO:755), KVIEEYTD (SEQ ID NO:756), KEEYTCD (SEQ ID NO:757), KIEEYTGD (SEQ ID NO:758), KVIEEYTGD (SEQ ID NO:759), KFVIEEYD (SEQ ID NO:760), KFVIEEYTD (SEQ ID NO:761), KFVIEEYTGD (SEQ ID NO:762), KFFVIEEYD (SEQ ID NO:763), KFFVIEEYTD (SEQ ID NO:764), KFFVIEEYTGD (SEQ ID NO:765), EEEYK (SEQ ID NO:766), EIEEYK (SEQ ID NO:767), EEEYTK (SEQ ID NO:768), EVIEEYK (SEQ ID NO:769), EIEEYTK (SEQ ID NO:770), EVIEEYTK (SEQ ID NO:771), EEEYTGK (SEQ ID NO:772), EIEEYTGK (SEQ ID NO:773), EVIEEYTGK (SEQ ID NO:774), EFVIEEYK (SEQ ID NO:775), EFVIEEYTK (SEQ ID NO:776), EFVIEEYTGK (SEQ ID NO:777), EFFVIEEYK (SEQ ID NO):778), EFFVIEEYTK (SEQ ID NO:779), EFFVIEEYTGK (SEQ ID NO:780), DCEEYK (SEQ ID NO:781), DIEEYCK (SEQ ID NO:782), DEEYTK (SEQ ID NO:783), DVIEEYK (SEQ ID NO:784), DIEEYTK (SEQ ID NO:785), DVIEEYTK (SEQ ID NO:786), DEEYTGK (SEQ ID NO:787), DIEEYTGK (SEQ ID NO:788), DVIEEYTGK (SEQ ID NO:789), DFVIEEYK (SEQ ID NO:790), DFVIEEYTK (SEQ ID NO:791), DFVIEEYTGK (SEQ ID NO:792), DFFVIEEYK (SEQ ID NO:793), DFFVIEEYTK (SEQ ID NO:794), DFFVIEEYTGK (SEQ ID NO:795), KEEYE (SEQ ID NO:796), KIEEYE (SEQ ID NO:797), KEEYTE (SEQ ID NO:798), KVIEEYE (SEQ ID NO:799), KIEEYTE (SEQ ID NO:800), KVIEEYTE (SEQ ID NO:801), KEEYTGE (SEQ ID NO:802), KIEEYTGE (SEQ ID NO:803), KVIEEYTGE (SEQ ID NO:804), KFVIEEYE (SEQ ID NO:805), KFVIEEYTE (SEQ ID NO:806), KFVIEEYTGE (SEQ ID NO:807), KFFVIEEYE (SEQ ID NO:808), KFFVIEEYTE (SEQ ID NO:809), KFFVIEEYTGE (SEQ ID NO:810), VIEEY (SEQ ID NO:811), IEEYT (SEQ ID NO:812), VIEEYT (SEQ ID NO:813), EEYTG (SEQ ID NO:814), IEEYTG (SEQ ID NO:815), VIEEYTG (SEQ ID NO:816), FVIEEY (SEQ ID NO:817), FVIEEYT (SEQ ID NO:818), FVIEEYTG (SEQ ID NO:819), FFVIEEY (SEQ ID NO:820), FFVIEEYT (SEQ ID NO:821), FFVIEEYTG (SEQ ID NO:822), CEAQC (SEQ ID NO:823), CVEAQC (SEQ ID NO:824), CEAQTC (SEQ ID NO:825), CSVEAQC (SEQ ID NO:826), CVEAQTC (SEQ ID NO:827), CSVEAQTC (SEQ ID NO:828), CEAQTGC (SEQ ID NO:829), CVEAQTGC (SEQ ID NO:830), CSVEAQTGC (SEQ ID NO:831), CFSVEAQC (SEQ ID NO:832), CFSVEAQTC (SEQ ID NO:833), CFSVEAQTGC (SEQ ID NO:834), CYFSVEAQC (SEQ ID NO:835), CYFSVEAQTC (SEQ ID NO:836), CYFSVEAQTGC (SEQ ID NO:837), KEAQD (SEQ ID NO:838), KVEAQD (SEQ ID NO:839), KEAQTD (SEQ ID NO:840), KSVEAQD (SEQ ID NO:841), KVEAQTD (SEQ ID NO:842), KSVEAQTD (SEQ ID NO:843), KEAQTGD (SEQ ID NO:844), KVEAQTGD (SEQ ID NO:845), KSVEAQTGD (SEQ ID NO:846), KFSVEAQD (SEQ ID NO:847), KFSVEAQTD (SEQ ID NO:848), KFSVEAQTGD (SEQ ID NO:849), KYFSVEAQD (SEQ ID NO:850), KYFSVEAQTD (SEQ ID NO:851), KYFSVEAQTGD (SEQ ID NO:852), EEAQK (SEQ ID NO:853), EVEAQK (SEQ ID NO:854), EEAQTK (SEQ ID NO:855), ESVEAQK (SEQ ID NO:856), EVEAQTK (SEQ ID NO:857), ESVEAQTK (SEQ ID NO:858), EEAQTGK (SEQ ID NO:859), EVEAQTGK (SEQ ID NO:860), ESVEAQTGK (SEQ ID NO:861), EFSVEAQK (SEQ ID NO:862), EFSVEAQTK (SEQ ID NO:863), EFSVEAQTGK (SEQ ID NO:864), EYFSVEAQK (SEQ ID NO:865), EYFSVEAQTK (SEQ ID NO:866), EYFSVEAQTGK (SEQ ID NO:867), DEAQK (SEQ ID NO:868), DVEAQK (SEQ ID NO:869), DEAQTK (SEQ ID NO:870), DSVEAQK (SEQ ID NO:871), DVEAQTK (SEQ ID NO:872), DSVEAQTK (SEQ ID NO:873), DEAQTGK (SEQ ID NO:874), DVEAQTGK (SEQ ID NO:875), SVEAQTGK (SEQ ID NO:876), DFSVEAQK (SEQ ID NO:877), DFSVEAQTK (SEQ ID NO:878), DFSVEAQTGK (SEQ ID NO:879), DYFSVEAQK (SEQ ID NO:880), DYFSVEAQTK (SEQ ID NO:881), DYFSVEAQTGK (SEQ ID NO:882), KEAQE (SEQ ID NO:883), KVEAQE (SEQ ID NO:884), KEAQTE (SEQ ID NO:885), KSVEAQE (SEQ ID NO:886), KVEAQTE (SEQ ID NO:887), KSVEAQTE (SEQ ID NO:888), KEAQTGE (SEQ ID NO:889), KVEAQTGE (SEQ ID NO:890), KSVEAQTGE (SEQ ID NO:891), KFSVEAQE (SEQ ID NO:892), KFSVEAQTE (SEQ ID NO:893), KFSVEAQTGE (SEQ ID NO:894), KYFSVEAQE (SEQ ID NO:895), KYFSVEAQTE (SEQ ID NO:896), KYFSVEAQTGE (SEQ ID NO:897), SVEAQ (SEQ ID NO:898), VEAQT (SEQ ID NO:899), SVEAQT (SEQ ID NO:900), EAQTG (SEQ ID NO:901), VEAQTG (SEQ ID NO:902), SVEAQTG (SEQ ID NO:903), FSVEAQ (SEQ ID NO:904), FSVEAQT (SEQ ID NO:905), FSVEAQTG (SEQ ID NO:906), YFSVEAQ (SEQ ID NO:907), YFSVEAQT (SEQ ID NO:908) and YFSVEAQTG (SEQ ID NO:909). Within the context of the present invention, underlined sequences are cyclized using any suitable method, as described herein.

Similarly, cyclic peptides may comprise any of the above cadherin-5 CAR sequence(s). Representative cyclic peptides include: CDAEC (SEQ ID NO:910), CVDAEC (SEQ ID NO:911), CDAETC (SEQ ID NO:912), CRVDAEC (SEQ ID NO:913), CVDAETC (SEQ ID NO:914), CRVDAETC (SEQ ID NO:915), CDAETGC (SEQ ID NO:916), CCDAETGC (SEQ ID NO:917), CRVDAETGC (SEQ ID NO:918), CFRVDAEC (SEQ ID NO:919), CFRVDAETC (SEQ ID NO:920), CFRVDAETGC (SEQ ID NO:921), CVFRVDAEC (SEQ ID NO:922), CVFRVDAETC (SEQ ID NO:923), CVFRVDAETGC (SEQ ID NO:924), DDAEK (SEQ ID NO:925), DVDAEK (SEQ ID NO:926), DRVDAEK (SEQ ID NO:927), DFRVDAEK (SEQ ID NO:928), DVFRVDAEK (SEQ ID NO:929), EDAEK (SEQ ID NO:930), EVDAEK (SEQ ID NO:931), ERVDAEK (SEQ ID NO:932), EFRVDAEK (SEQ ID NO:933), EVFRVDAEK (SEQ ID NO:934), KDAED (SEQ ID NO:935), KVDAED (SEQ ID NO:936), KDAETD (SEQ ID NO:937), KRVDAED (SEQ ID NO:938), KVDAETD (SEQ ID NO:939), KRVDAETD (SEQ ID NO:940), KDAETGD (SEQ ID NO:941), KVDAETGD (SEQ ID NO:942), KRVDAETGD (SEQ ID NO:943), KFRVDAED (SEQ ID NO:944), KFRVDAETD (SEQ ID NO:945), KFRVDAETGD (SEQ ID NO:946), KVFRVDAED (SEQ ID NO:947), KVFRVDAETD (SEQ ID NO:948), KVFRVDAETGD (SEQ ID NO:949), VDAEK (SEQ ID NO:950), IDAES (SEQ ID NO:951), VDAES (SEQ ID NO:952), DAETG (SEQ ID NO:953), VDAETG (SEQ ID NO:954), KDAEE (SEQ ID NO:955), KVDAE (SEQ ID NO:956), KDAETE (SEQ ID NO:957), KRVDAE (SEQ ID NO:958), KVDAETE (SEQ ID NO:959), KRVDAETE (SEQ ID NO:960), KDAETGE (SEQ ID NO:961), KVDAETGE (SEQ ID NO:962), KRVDAETGE (SEQ ID NO:963), KFRVDAE (SEQ ID NO:964), KFRVDAETE (SEQ ID NO:965), KFRVDAETGE (SEQ ID NO:966), KVFRVDAE (SEQ ID NO:967), KVFRVDAETE (SEQ ID NO:968), KVFRVDAETGE (SEQ ID NO:969), VDAET (SEQ ID NO:970), VDAETG (SEQ ID NO:971), DAETG (SEQ ID NO:972), RVDAE (SEQ ID NO:973), RVDAET (SEQ ID NO:974), RVDAETG (SEQ ID NO:975), FRVDAE (SEQ ID NO:976), FRVDAET (SEQ ID NO:977), FRVDAETG (SEQ ID NO:978), VFRVDAE (SEQ ID NO:979), VFRVDAET (SEQ ID NO:980) and VFRVDAETG (SEQ ID NO:981).

Any cadherin-6 CAR sequence(s) may be formulated into a cyclic peptide. Representative cyclic peptides include: CNENC (SEQ ID NO:983), CINENC (SEQ ID NO:984), CNENTC (SEQ ID NO:985), CIINENC (SEQ ID NO:986), CINENTC (SEQ ID NO:987), CIINENTC (SEQ ID NO:988), CNENTGC (SEQ ID NO:989), CINENTGC (SEQ ID NO:990), CIINENTGC (SEQ ID NO:991), CFIINENC (SEQ ID NO:992), CFIINENTC (SEQ ID NO:993), CFIINENTGC (SEQ ID NO:994), CLFIINENC (SEQ ID NO:995), CLFIINENTC (SEQ ID NO:996), CLFIINENTGC (SEQ ID NO:997), DNENK (SEQ ID NO:998), DINENK (SEQ ID NO:999), DIINENK (SEQ ID NO:1000), DFIINENK (SEQ ID NO:1001), DLFIINENK (SEQ ID NO:1002), DNENTK (SEQ ID NO:982), DINENTK (SEQ ID NO:2883), DIINENTK (SEQ ID NO:2884), DFIINENTK (SEQ ID NO:2885), DLFIINENTK (SEQ ID NO:2946), DNENTGK (SEQ ID NO:2947), DINENTGK (SEQ ID NO:2948), DIINENTGK (SEQ ID NO:3009), DFIINENTGK (SEQ ID NO:3010), DLFIINENTGK (SEQ ID NO:3011), ENENTK (SEQ ID NO:3055), EINENTK (SEQ ID NO:3630), EIINENTK (SEQ ID NO:3736), EFIINENTK (SEQ ID NO:3842), ELFIINENTK (SEQ ID NO:3890), ENENTGK (SEQ ID NO:3891), EINENTGK (SEQ ID NO:3892), EIINENTGK (SEQ ID NO:3893), EFIINENTGK (SEQ ID NO:3894), ELFIINENTGK (SEQ ID NO:3895), ENENK (SEQ ID NO:1003), EINENK (SEQ ID NO:1004), EIINENK (SEQ ID NO:1005), EFIINENK (SEQ ID NO:1006), ELFIINENK (SEQ ID NO:1007), KNEND (SEQ ID NO:1008), KINEND (SEQ ID NO:1009), KNENTD (SEQ ID NO:1010), KIINEND (SEQ ID NO:1011), KINENTD (SEQ ID NO:1012), KIINENTD (SEQ ID NO:1013), KNENTGD (SEQ ID NO:1014), KINENTGD (SEQ ID NO:1015), KIINENTGD (SEQ ID NO:1016), KFIINEND (SEQ ID NO:1017), KFIINENTD (SEQ ID NO:1018), KFIINENTGD (SEQ ID NO:1019), KLFIINEND (SEQ ID NO:1020), KLFIINENTD (SEQ ID NO:1021), KLFIINENTGD (SEQ ID NO:1022), VNENT (SEQ ID NO:1023), INENT (SEQ ID NO:1024), IINENT (SEQ ID NO:1025), NENTG (SEQ ID NO:1026), INENTG (SEQ ID NO:1027) KNENE (SEQ ID NO:1028), KINENE (SEQ ID NO:1029), KNENTE (SEQ ID NO:1030), KIINENE (SEQ ID NO:1031), KINENTE (SEQ ID NO:1032), KIINENTE (SEQ ID NO.1033), KNENTGE (SEQ ID NO:1034), KINENTGE (SEQ ID NO:1035), KIINENTGE (SEQ ID NO:1036), KFIINENE (SEQ ID NO:1037), KFIINENTE (SEQ ID NO:1038), KFIINENTGE (SEQ ID NO:1039), KLFIINENE (SEQ ID NO:1040), KLFIINENTE (SEQ ID NO:1041), KLFIINENTGE (SEQ ID NO:1042), IINEN (SEQ ID NO:1043), FIINEN (SEQ ID NO:1044), FIINENT (SEQ ID NO:1045), FIINENTG (SEQ ID NO:1046), LFIINEN (SEQ ID NO:1047), LFIINENT (SEQ ID NO:1048), LFIINENTG (SEQ ID NO:1049), CEEYC (SEQ ID NO:1050), CEEYTC (SEQ ID NO:1051), CEEYTGC (SEQ ID NO:1052), CLEEYC (SEQ ID NO:1053), CLEEYTC (SEQ ID NO:1054), CLEEYTGC (SEQ ID NO:1055), CLLEEYC (SEQ ID NO:1056), CLLEEYTGC (SEQ ID NO:1057), CFLLEEYC (SEQ ID NO:1058), CLLEEYTC (SEQ ID NO:1059), CFLLEEYTGC (SEQ ID NO:1060), CFFLLEEYC (SEQ ID NO:1061), CFFLLEEYTC (SEQ ID NO:1062), CFFLLEEYTGC (SEQ ID NO:1063), CESEC (SEQ ID NO:1064), CESETC (SEQ ID NO:1065), CESETGC (SEQ ID NO:1066), CVESEC (SEQ ID NO:1067), CVSESTC (SEQ ID NO:1068), CVESETGC (SEQ ID NO:1069), CSVESEC (SEQ ID NO:1070), CSVESETC (SEQ ID NO:1071), CSVESETGC (SEQ ID NO:1072), CFSVESEC (SEQ ID NO:1073), CFSVESETC (SEQ ID NO:1074), CFSVESETGC (SEQ ID NO:1075), CYFSVESEC (SEQ ID NO:1076), CYFSVESETC (SEQ ID NO:1077), CYFSVESETGC (SEQ ID NO:1078), CDSGC (SEQ ID NO:1079), CDSGNC (SEQ ID NO:1080), CDSGNGC (SEQ ID NO:1081), CIDSGC (SEQ ID NO:1082), CIDSGNC (SEQ ID NO:1083), CIDSGNGC (SEQ ID NO:1084), CNIDSGC (SEQ ID NO:1085), CNIDSGNC (SEQ ID NO:1086), CNIDSGNGC (SEQ ID NO:1087), CFNIDSGC (SEQ ID NO:1088), CFNIDSGNC (SEQ ID NO:1089), CFNIDSGNGC (SEQ ID NO:1090), CIFNIDSGC (SEQ ID NO:1091), CIFNIDSGNC (SEQ ID NO:1092), CIFNIDSGNGC (SEQ ID NO:1093), KEEYD (SEQ ID NO:1094), KLEEYD (SEQ ID NO:1095), KEEYTD (SEQ ID NO:1096), KEEYTGD (SEQ ID NO:1097), KLEEYTD (SEQ ID NO:1098), KLEEYTGD (SEQ ID NO:1099), KLLEEYD (SEQ ID NO:1100), KLLEEYTGD (SEQ ID NO:1101), KFLLEEYD (SEQ ID NO:1102), KLLEEYTD (SEQ ID NO:1103), KFLLEEYTGD (SEQ ID NO:1104), KFFLLEEYD (SEQ ID NO:1105), KFFLLEEYTD (SEQ ID NO:1106), KFFLLEEYTGD (SEQ ID NO:1107), KESED (SEQ ID NO:1108), KESETD (SEQ ID NO:1109), KESETGD (SEQ ID NO:1110), KVESED (SEQ ID NO:1111), KVSESTD (SEQ ID NO:1112), KVESETGD (SEQ ID NO:1113), KSVESED (SEQ ID NO:1114), KSVESETGD (SEQ ID NO:1115), KSVESETD (SEQ ID NO:1116), KFSVESED (SEQ ID NO:1117), KFSVESETD (SEQ ID NO:1118), KFSVESETGD (SEQ ID NO:1119), KYFSVESED (SEQ ID NO:1120), KYFSVESETD (SEQ ID NO:1121), KYFSVESETGD (SEQ ID NO:1122), KDSGD (SEQ ID NO:1123), KDSGND (SEQ ID NO:1124), KDSGNGD (SEQ ID NO:1125), KIDSGD (SEQ ID NO:1126), KIDSGND (SEQ ID NO:1127), KIDSGNGD (SEQ ID NO:1128), KNIDSGD (SEQ ID NO:1129), KNIDSGND (SEQ ID NO:1130), KNIDSGNGD (SEQ ID NO:1131), KFNIDSGD (SEQ ID NO:1132), KFNIDSGND (SEQ ID NO:1133), KFNIDSGNGD (SEQ ID NO:1134), KIFNIDSGD (SEQ ID NO:1135), KIFNIDSGND (SEQ ID NO:1136), KIFNIDSGNGD (SEQ ID NO:1137), EEEYK (SEQ ID NO:1138), EEEYTK (SEQ ID NO:1139), EEEYTGK (SEQ ID NO:1140), ELEEYK (SEQ ID NO:1141), EEEYTK (SEQ ID NO:1142), ELEEYTGK (SEQ ID NO:1143), ELLEEYK (SEQ ID NO:1144), ELLEEYTGK (SEQ ID NO:1145), EFLLEEYK (SEQ ID NO:1146), ELLEEYTK (SEQ ID NO:1147), EFLLEEYTGK (SEQ ID NO:1148), EFFLLEEYK (SEQ ID NO:1149), EFFLLEEYTK (SEQ ID NO:1150), EFFLLEEYTGK (SEQ ID NO:1151), EESEK (SEQ ID NO:1152), EESETK (SEQ ID NO:1153), EESETGK (SEQ ID NO):1154), EVESEK (SEQ ID NO:1155), EVSESTK (SEQ ID NO:1156), EVESETGK (SEQ ID NO:1157), ESVESEK (SEQ ID NO:1158), ESVESETK (SEQ ID NO:1159), ESVESETGK (SEQ ID NO:1160), EFSVESEK (SEQ ID NO:1161), EFSVESETK (SEQ ID NO:1162), EFSVESETGK (SEQ ID NO:1163), EYFSVESEK (SEQ ID NO:1164), EYFSVESETK (SEQ ID NO:1165), EYFSVESETGK (SEQ ID NO:1166), EDSGK (SEQ ID NO:1167), EDSGNK (SEQ ID NO:1168), EDSGNGK (SEQ ID NO:1169), EIDSGK (SEQ ID NO:1170), EIDSGNK (SEQ ID NO:1171), EIDSGNGK (SEQ ID NO:1172), ENIDSGK (SEQ ID NO:1173), ENIDSGNK (SEQ ID NO:1174), ENIDSGNGK (SEQ ID NO:1175), EFNIDSGK (SEQ ID NO:1176), EFNIDSGNK (SEQ ID NO:1177), EFNIDSGNGK (SEQ ID NO:1178), EIFNIDSGK (SEQ ID NO:1179), EIFNIDSGNK (SEQ ID NO:1180), EIFNIDSGNGK (SEQ ID NO:1181), DEEYK (SEQ ID NO:1182), DLEEYK (SEQ ID NO:1183), DLEEYTK (SEQ ID NO:1184), DLEEYTGK (SEQ ID NO:1185), DLLEEYK (SEQ ID NO:1186), DLLEEYTGK (SEQ ID NO:1187), DFLLEEYK (SEQ ID NO:1188), DLLEEYTK (SEQ ID NO:1189), DFLLEEYTGK (SEQ ID NO:1190), DFFLLEEYK (SEQ ID NO:1191), DFFLLEEYTK (SEQ ID NO:1192), DFFLLEEYTGK (SEQ ID NO:1193), DESEK (SEQ ID NO:1194), DESETK (SEQ ID NO:1195), DESETGK (SEQ ID NO:1196), DVESEK (SEQ ID NO:1197), DVSESTK (SEQ ID NO:1198), DVESETGK (SEQ ID NO:1199), DSVESEK (SEQ ID NO:1200), DSVESETK (SEQ ID NO:1201), DSVESETGK (SEQ ID NO:1202), DFSVESEK (SEQ ID NO:1203), DFSVESETK (SEQ ID NO:1204), DFSVESETGK (SEQ ID NO:1205), DYFSVESEK (SEQ ID NO:1206), DYFSVESETK (SEQ ID NO:1207), DYFSVESETGK (SEQ ID NO:1208), DDSGK (SEQ ID NO:1209), DDSGNK (SEQ ID NO:1210), DDSGNGK (SEQ ID NO:1211), DIDSGK (SEQ ID NO:1212), DIDSGNK (SEQ ID NO:1213), DIDSGNGK (SEQ ID NO:1214), DNIDSGK (SEQ ID NO:1215), DNIDSGNK (SEQ ID NO:1216), DNIDSGNGK (SEQ ID NO:1217), DFNIDSGK (SEQ ID NO:1218), DFNIDSGNK (SEQ ID NO:1219), DFNIDSGNGK (SEQ ID NO:1220), DIFNIDSGK (SEQ ID NO:1221), DIFNIDSGNK (SEQ ID NO:1222), DIFNIDSGNGK (SEQ ID NO:1223), KEEYE (SEQ ID NO:1224), KLEEYE (SEQ ID NO:1225), KLEEYTE (SEQ ID NO:1226), KLEEYTGE (SEQ ID NO:1227), KLLEEYE (SEQ ID NO:1228), KLLEEYTGE (SEQ ID NO:1229), KFLLEEYE (SEQ ID NO:1230), KLLEEYTE (SEQ ID NO:1231), KFLLEEYTGE (SEQ ID NO:1232), KFFLLEEYE (SEQ ID NO:1233), KFFLLEEYTE (SEQ ID NO:1234), KFFLLEEYTGE (SEQ ID NO:1235), KNENE (SEQ ID NO:1236), KNENTE (SEQ ID NO:1237), KINENTGE (SEQ ID NO:1238), KESEE (SEQ ID NO:1239), KESETE (SEQ ID NO:1240), KESETGE (SEQ ID NO:1241), KVESEE (SEQ ID NO:1242) KVSESTE (SEQ ID NO:1243), KVESETGE (SEQ ID NO:1244), KSVESEE (SEQ ID NO:1245), KSVESETE, (SEQ ID NO:1246), KSVESETGE (SEQ ID NO:1247), KFSVESEE (SEQ ID NO:1248), KFSVESETE (SEQ ID NO:1249), KFSVESETGE (SEQ ID NO:1250), KYFSVESEE (SEQ ID NO:1251), KYFSVESETE (SEQ ID NO:1252), KYFSVESETGE (SEQ ID NO:1253), KDSGE (SEQ ID NO:1254), KDSGNE (SEQ ID NO:1255), KDSGNGE (SEQ ID NO:1256), KIDSGE (SEQ ID NO:1257), KIDSGNE (SEQ ID NO:1258), KIDSGNGE (SEQ ID NO:1259), KNIDSGE (SEQ ID NO:1260), KNIDSGNE (SEQ ID NO:1261), KNIDSGNGE (SEQ ID NO:1262), KFNIDSGE (SEQ ID NO:1263), KFNIDSGNE (SEQ ID NO:1264), KFNIDSGNGE (SEQ ID NO:1265), KIFNIDSGE (SEQ ID NO:1266), KIFNIDSGNE (SEQ ID NO:1267), KIFNIDSGNGE (SEQ ID NO:1268), LEEYT (SEQ ID NO:1269), LEEYTG (SEQ ID NO:1270), LLEEY (SEQ ID NO:1271), LLEEYTG (SEQ ID NO:1272), FLLEEY (SEQ ID NO:1273), LLEEYT (SEQ ID NO:1274), FLLEEYTG (SEQ ID NO:1275), FFLLEEY (SEQ ID NO:1276), FFLLEEYT (SEQ ID NO:1277), FFLLEEYTG (SEQ ID NO:1278), ESETG (SEQ ID NO:1279), VSEST (SEQ ID NO:1280), VESETG (SEQ ID NO:1281), SVESE (SEQ ID NO:1282), SVESET (SEQ ID NO:1283), SVESETG (SEQ ID NO:1284), FSVESE (SEQ ID NO:1285), FSVESET (SEQ ID NO:1286), FSVESETG (SEQ ID NO:1287), YFSVESE (SEQ ID NO:1288), YFSVESET (SEQ ID NO:1289), YFSVESETG (SEQ ID NO:1290), DSGNG (SEQ ID NO:1291), IDSGN (SEQ ID NO:1292), IDSGNG (SEQ ID NO:1293), NIDSG (SEQ ID NO:1294), NIDSGN (SEQ ID NO:1295), NIDSGNG (SEQ ID NO:1296), FNIDSG (SEQ ID NO:1297), FNIDSGN (SEQ ID NO:1298), FNIDSGNG (SEQ ID NO:1299), IFNIDSG (SEQ ID NO:1300), IFNIDSGN (SEQ ID NO:1301) and IFNIDSGNG (SEQ ID NO:1302).

Representative cyclic peptides comprising a cadherin-7 CAR sequence include: CDENC (SEQ ID NO:1303), CIDENC (SEQ ID NO:1304), CDENTC (SEQ ID NO:1305), CIIDENC (SEQ ID NO:1306), CIDENTC (SEQ ID NO:1307), CIIDENTC (SEQ ID NO:1308), CDENTGC (SEQ ID NO:1309), CIDENTGC (SEQ ID NO:1310), CIIDENTGC (SEQ ID NO:1311), CFIIDENC (SEQ ID NO:1312), CFIIDENTC (SEQ ID NO:1313), CFIIDENTGC (SEQ ID NO:1314), CIFIIDENC (SEQ ID NO:1315), CIFIIDENTC (SEQ ID NO:1316), CIFIIDENTGC (SEQ ID NO:1317), DDENK (SEQ ID NO:1319), DIDENK (SEQ ID NO:1320), DIIDENK (SEQ ID NO:1321), DFIIDENK (SEQ ID NO:1322), DIFIIDENK (SEQ ID NO:1323), DDENTK (SEQ ID NO:1318), DIDENTK (SEQ ID NO:1344), DIIDENTK (SEQ ID NO:3896), DFIIDENTK (SEQ ID NO:3897), DIFIIDENTK (SEQ ID NO:3898), DDENTGK (SEQ ID NO:3899), DIDENTGK (SEQ ID NO:3900), DIIDENTGK (SEQ ID NO:3901), DFIIDENTGK (SEQ ID NO:3902), DIFIIDENTGK (SEQ ID NO:3903), EDENTK (SEQ ID NO:3904), EIDENTK (SEQ ID NO:3905), EIIDENTK (SEQ ID NO:3906), EFIIDENTK (SEQ ID NO:3907), EIFIIDENTK (SEQ ID NO:3908), EDENTGK (SEQ ID NO:3909), EIDENTGK (SEQ ID NO:3910), EIIDENTGK (SEQ ID NO:3911), EFIIDENTGK (SEQ ID NO:3912), EIFIIDENTGK (SEQ ID NO:3913), EDENK (SEQ ID NO:1324), EIDENK (SEQ ID NO:1325), EIIDENK (SEQ ID NO:1326), EFIIDENK (SEQ ID NO:1327), EIFIIDENK (SEQ ID NO:1328), KDEND (SEQ ID NO:1329), KIDEND (SEQ ID NO:1330), KDENTD (SEQ ID NO:1331), KIIDEND (SEQ ID NO:1332), KIDENTD (SEQ ID NO:1333), KIIDENTD (SEQ ID NO:1334), KDENTGD (SEQ ID NO:1335), KIDENTGD (SEQ ID NO:1336), KIIDENTGD (SEQ ID NO:1337), KFIIDEND (SEQ ID NO:1338), KFIIDENTD (SEQ ID NO:1339), KFIIDENTGD (SEQ ID NO:1340), KIFIIDEND (SEQ ID NO:1341), KIFIIDENTD (SEQ ID NO:1342), KIFIIDENTGD (SEQ ID NO:1343), IDENT (SEQ ID NO:1345), IIDENT (SEQ ID NO:1346), DENTG (SEQ ID NO:1347), IDENTG (SEQ ID NO:1348) KDENE (SEQ ID NO:1349), KIDENE (SEQ ID NO:1350), KDENTE (SEQ ID NO:1351), KIIDENE (SEQ ID NO:1352), KIDENTE (SEQ ID NO:1353), KIIDENTE (SEQ ID NO:1354), KDENTGE (SEQ ID NO:1355), KIDENTGE (SEQ ID NO:1356), KIIDENTGE (SEQ ID NO:1357), KFIIDENE (SEQ ID NO:1358), KFIIDENTE (SEQ ID NO:1359), KFIIDENTGE (SEQ ID NO:1360), KIFIIDENE (SEQ ID NO:1361), KIFIIDENTE (SEQ ID NO:1362), KIFIIDENTGE (SEQ ID NO:1363), DDENTK (SEQ ID NO:1364), IIDEN (SEQ ID NO:1365), IIDENTG (SEQ ID NO:1366), FIIDEN (SEQ ID NO:1367), FIIDENT (SEQ ID NO:1368), FIIDENTG (SEQ ID NO:1369), IFIIDEN (SEQ ID NO:1370), IFIIDENT (SEQ ID NO:1371), IFIIDENTG (SEQ ID NO:1372), CEPKC (SEQ ID NO:1373), CEPKTC (SEQ ID NO:1374), CEPKTGC (SEQ ID NO:1375), CVEPKC (SEQ ID NO:1376), CVEPKTC (SEQ ID NO:1377), CVEPKTGC (SEQ ID NO:1378), CSVEPKC (SEQ ID NO:1379), CSVEPKTC (SEQ ID NO:1380), CSVEPKTGC (SEQ ID NO:1381), CFSVEPKC (SEQ ID NO:1382), CFSVEPKTC (SEQ ID NO:1383), CFSVEPKTGC (SEQ ID NO:1384), CYFSVEPKC (SEQ ID NO:1385), CYFSVEPKTC (SEQ ID NO:1386), CYFSVEPKTGC (SEQ ID NO:1387), CDANC (SEQ ID NO:1388), CDANSC (SEQ ID NO:1389), CDANSGC (SEQ ID NO:1390), CIDANC (SEQ ID NO:1391), CIDANSC (SEQ ID NO:1392), CIDANSGC (SEQ ID NO:1393), CNIDANC (SEQ ID NO:1394), CNIDANSC (SEQ ID NO:1395), CNIDANSGC (SEQ ID NO:1396), CFNIDANC (SEQ ID NO:1397), CFNIDANSC (SEQ ID NO:1398), CFNIDANSGC (SEQ ID NO:1399), CYFNIDANC (SEQ ID NO:1400), CYFNIDANSC (SEQ ID NO:1401), CYFNIDANSGC (SEQ ID NO:1402), EEPKK (SEQ ID NO:1403), EEPKTK (SEQ ID NO:1404), EEPKTGK (SEQ ID NO:1405), EVEPKK (SEQ ID NO:1406), EVEPKTK (SEQ ID NO:1407), EVEPKTGK (SEQ ID NO:1408), ESVEPKK (SEQ ID NO:1409), ESVEPKTK (SEQ ID NO:1410), ESVEPKTGK (SEQ ID NO:1411), EFSVEPKK (SEQ ID NO:1412), EFSVEPKTK (SEQ ID NO:1413), EFSVEPKTGK (SEQ ID NO:1414), EYFSVEPKK (SEQ ID NO:1415), EYFSVEPKTK (SEQ ID NO:1416), EYFSVEPKTGK (SEQ ID NO:1417), EDANK (SEQ ID NO:1418), EDANSK (SEQ ID NO:1419), EDANSGK (SEQ ID NO:1420), EIDANK (SEQ ID NO:1421), EIDANSK (SEQ ID NO:1422), EIDANSGK (SEQ ID NO:1423), ENIDANK (SEQ ID NO:1424), ENIDANSK (SEQ ID NO:1425), ENIDANSGK (SEQ ID NO:1426), EFNIDANK (SEQ ID NO:1427), EFNIDANSK (SEQ ID NO:1428), EFNIDANSGK (SEQ ID NO:1429), EYFNIDANK (SEQ ID NO:1430), EYFNIDANSK (SEQ ID NO:1431), EYFNIDANSGK (SEQ ID NO:1432), KDAND (SEQ ID NO:1433), KIDAND (SEQ ID NO:1434), KDANSD (SEQ ID NO:1435), KNIDAND (SEQ ID NO:1436), KIDANSD (SEQ ID NO:1437), KNIDANSD (SEQ ID NO:1438), KDANSGD (SEQ ID NO:1439), KIDANSGD (SEQ ID NO:1440), KNIDANSGD (SEQ ID NO:1441), KFNIDAND (SEQ ID NO:1442), KFNIDANSD (SEQ ID NO:1443), KFNIDANSGD (SEQ ID NO:1444), KYFNIDAND (SEQ ID NO:1445), KYFNIDANSD (SEQ ID NO:1446), KYFNIDANSGD (SEQ ID NO:1447), KEPKD (SEQ ID NO:1448), KEPKTD (SEQ ID NO:1449), KEPKTGD (SEQ ID NO:1450), KVEPKD (SEQ ID NO:1451), KVEPKTD (SEQ ID NO:1452), KVEPKTGD (SEQ ID NO:1453), KSVEPKD (SEQ ID NO:1454), KSVEPKTD (SEQ ID NO:1455), KSVEPKTGD (SEQ ID NO:1456), KFSVEPKD (SEQ ID NO.1457), KFSVEPKTD (SEQ ID NO:1458), KFSVEPKTGD (SEQ ID NO:1459), KYFSVEPKD (SEQ ID NO:1460), KYFSVEPKTD (SEQ ID NO:1461), KYFSVEPKTGD (SEQ ID NO:1462), KDAND (SEQ ID NO:1463), KDANSD (SEQ ID NO:1464), KDANSGD (SEQ ID NO:1465), KIDAND (SEQ ID NO:1466), KIDANSD (SEQ ID NO:1467), KIDANSGD (SEQ ID NO:1468), KNIDAND (SEQ ID NO:1469), KNIDANSD (SEQ ID NO:1470), KNIDANSGD (SEQ ID NO:1471), KFNIDAND (SEQ ID NO:1472), KFNIDANSD (SEQ ID NO:1473), KFNIDANSGD (SEQ ID NO:1474), KYFNIDAND (SEQ ID NO:1475), KYFNIDANSD (SEQ ID NO:1476), KYFNIDANSGD (SEQ ID NO:1477), DEPKK (SEQ ID NO:1478), DEPKTK (SEQ ID NO:1479), DEPKTGK (SEQ ID NO:1480), DVEPKK (SEQ ID NO:1481), DVEPKTK (SEQ ID NO:1482), DVEPKTGK (SEQ ID NO:1483), DSVEPKK (SEQ ID NO:1484), DSVEPKTK (SEQ ID NO:1485), DSVEPKTGK (SEQ ID NO:1486), DFSVEPKK (SEQ ID NO:1487), DFSVEPKTK (SEQ ID NO:1488), DFSVEPKTGK (SEQ ID NO:1489), DYFSVEPKK (SEQ ID NO:1490), DYFSVEPKTK (SEQ ID NO:1491), DYFSVEPKTGK (SEQ ID NO:1492), DDANK (SEQ ID NO:1493), DDANSK (SEQ ID NO:1494), DDANSGK (SEQ ID NO:1495), DIDANK (SEQ ID NO:1496), DIDANSK (SEQ ID NO:1497), DIDANSGK (SEQ ID NO:1498), DNIDANK (SEQ ID NO:1499), DNIDANSK (SEQ ID NO:1500), DNIDANSGK (SEQ ID NO:1501), DFNIDANK (SEQ ID NO:1502), DFNIDANSK (SEQ ID NO:1503), DFNIDANSGK (SEQ ID NO:1504), DYFNIDANK (SEQ ID NO:1505), DYFNIDANSK (SEQ ID NO:1506), DYFNIDANSGK (SEQ ID NO:1507), KDENE (SEQ ID NO:1508), KDENTE (SEQ ID NO:1509), KDENTGE (SEQ ID NO:1510), KIDENE (SEQ ID NO:1511), KIDENTE (SEQ ID NO:1512), KIDENTGE (SEQ ID NO:1513), KIIDENE (SEQ ID NO:1514), KIIDENTE (SEQ ID NO:1515), KIIDENTGE (SEQ ID NO:1516), KFIIDENE (SEQ ID NO:1517), KFIIDENTE (SEQ ID NO:1518), KFIIDENTGE (SEQ ID NO:1519), KIFIIDENE (SEQ ID NO:1520), KIFIIDENTE (SEQ ID NO:1521), KIFIIDENTGE (SEQ ID NO:1522), KEPKE (SEQ ID NO:1523), KEPKTE (SEQ ID NO:1524), KEPKTGE (SEQ ID NO:1525), KVEPKE (SEQ ID NO:1526), KVEPKTE (SEQ ID NO:1527), KVEPKTGE (SEQ ID NO:1528), KSVEPKE (SEQ ID NO:1529), KSVEPKTE (SEQ ID NO:1530), KSVEPKTGE (SEQ ID NO:1531), KFSVEPKE (SEQ ID NO:1532), KFSVEPKTE (SEQ ID NO:1533), KFSVEPKTGE (SEQ ID NO:1534), KYFSVEPKE (SEQ ID NO:1535), KYFSVEPKTE (SEQ ID NO:1536), KYFSVEPKTGE (SEQ ID NO:1537), KDANE (SEQ ID NO:1538), KDANSE (SEQ ID NO:1539), KDANSGE (SEQ ID NO:1540), KIDANE (SEQ ID NO:1541), KIDANSE (SEQ ID NO:1542), KIDANSGE (SEQ ID NO:1543), KNIDANE (SEQ ID NO:1544), KNIDANSE (SEQ ID NO:1545), KNIDANSGE (SEQ ID NO:1546), KFNIDANE (SEQ ID NO:1547), KFNIDANSE (SEQ ID NO:1548), KFNIDANSGE (SEQ ID NO:1549), KYFNIDANE (SEQ ID NO:1550), KYFNIDANSE (SEQ ID NO:1551), KYFNIDANSGE (SEQ ID NO:1552), DENTG (SEQ ID NO:1553), IDENT (SEQ ID NO:1554), IDENTG (SEQ ID NO:1555), IIDEN (SEQ ID NO:1556), IIDENT (SEQ ID NO:1557), IIDENTG (SEQ ID NO:1558), FIIDEN (SEQ ID NO:1559), FIIDENT (SEQ ID NO:1560), FIIDENTG (SEQ ID NO:1561), IFIIDEN (SEQ ID NO:1562), IFIIDENT (SEQ ID NO:1563), IFIIDENTG (SEQ ID NO:1564), EPKTG (SEQ ID NO:1565), VEPKT (SEQ ID NO:1566), VEPKTG (SEQ ID NO:1567), SVEPK (SEQ ID NO:1568), SVEPKT (SEQ ID NO:1569), SVEPKTG (SEQ ID NO:1570), FSVEPK (SEQ ID NO:1571), FSVEPKT (SEQ ID NO:1572), FSVEPKTG (SEQ ID NO:1573), YFSVEPK (SEQ ID NO:1574), YFSVEPKT (SEQ ID NO:1575), YFSVEPKTG (SEQ ID NO:1576), DANSG (SEQ ID NO:1577), IDANS (SEQ ID NO:1578), IDANSG (SEQ ID NO:1579), NIDAN (SEQ ID NO:1580), NIDANS (SEQ ID NO:1581), NIDANSG (SEQ ID NO:1582), FNIDAN (SEQ ID NO:1583), FNIDANS (SEQ ID NO:1584), FNIDANSG (SEQ ID NO:1585), YFNIDAN (SEQ ID NO:1586), YFNIDANS (SEQ ID NO:1587) and YFNIDANSG (SEQ ID NO:1588).

Representative cyclic peptides comprising a cadherin-8 CAR sequence include: CNDVC (SEQ ID NO:1589), CINDVC (SEQ ID NO:1590), CNDVTC (SEQ ID NO:1591), CQINDVC (SEQ ID NO:1592), CINDVTC (SEQ ID NO:1593), CQINDVTC (SEQ ID NO:1594), CNDVTGC (SEQ ID NO:1595), CINDVTGC (SEQ ID NO:1596), CQINDVTGC (SEQ ID NO:1597), CFQINDVC (SEQ ID NO:1598), CFQINDVTC (SEQ ID NO:1599), CFQINDVTGC (SEQ ID NO:1600), CIFQINDVC (SEQ ID NO:1601), CIFQINDVTC (SEQ ID NO:1602), CIFQINDVTGC (SEQ ID NO:1603), DNDVK (SEQ ID NO:1604), DINDVK (SEQ ID NO:1605), DQINDVK (SEQ ID NO:1606), DFQINDVK (SEQ ID NO:1607), DIFQINDVK (SEQ ID NO:1608), DNDVTK (SEQ ID NO:3924), DINDVTK (SEQ ID NO:3925), DQINDVTK (SEQ ID NO:3926), DFQINDVTK (SEQ ID NO:3927), DIFQINDVTK (SEQ ID NO:3928), DNDVTGK (SEQ ID NO:3929), DINDVTGK (SEQ ID NO:3930), DQINDVTGK (SEQ ID NO:3931), DFQINDVTGK (SEQ ID NO:3932), DIFQINDVTGK (SEQ ID NO:3933), ENDVTK (SEQ ID NO:3914), EINDVTK (SEQ ID NO:3915), EQINDVTK (SEQ ID NO:3916), EFQINDVTK (SEQ ID NO:3917), EIFQINDVTK (SEQ ID NO:3918), ENDVTGK (SEQ ID NO:3919), EINDVTGK (SEQ ID NO:3920), EQINDVTGK (SEQ ID NO:3921), EFQINDVTGK (SEQ ID NO:3922), EIFQINDVTGK (SEQ ID NO:3923), ENDVK (SEQ ID NO:1609), EINDVK (SEQ ID NO:1610), EQINDVK (SEQ ID NO:1611), EFQINDVK (SEQ ID NO:1612), EIFQINDVK (SEQ ID NO:1613), KNDVD (SEQ ID NO:1614), KINDVD (SEQ ID NO:1615), KNDVTD (SEQ ID NO:1616), KQINDVD (SEQ ID NO:1617), KINDVTD (SEQ ID NO:1618), KQINDVTD (SEQ ID NO:1619), KNDVTGD (SEQ ID NO:1620), KINDVTGD (SEQ ID NO:1621), KQINDVTGD (SEQ ID NO:1622), KFQINDVD (SEQ ID NO:1623), KFQINDVTD (SEQ ID NO:1624), KFQINDVTGD (SEQ ID NO:1625), KIFQINDVD (SEQ ID NO:1626), KIFQINDVTD (SEQ ID NO:1627), KIFQINDVTGD (SEQ ID NO:1628), VNDVT (SEQ ID NO:1629), INDVT (SEQ ID NO:1630), QINDVT (SEQ ID NO:1631), NDVTG (SEQ ID NO:1632), INVTG (SEQ ID NO:1633) KNDVE (SEQ ID NO:1634), KINDVE (SEQ ID NO:1635), KNDVTE (SEQ ID NO:1636), KQINDVE (SEQ ID NO:1637), KINDVTE (SEQ ID NO:1638), KQINDVTE (SEQ ID NO:1639), KNDVTGE (SEQ ID NO:1640), KINDVTGE (SEQ ID NO:1641), KQINDVTGE (SEQ ID NO:1642), KFQINDVE (SEQ ID NO:1643), KFQINDVTE (SEQ ID NO:1644), KFQINDVTGE (SEQ ID NO:1645), KIFQINDVE (SEQ ID NO:1646), KIFQINDVTE (SEQ ID NO:1647), KIFQINDVTGE (SEQ ID NO:1648), CEEFC (SEQ ID NO:1649), CEEFSC (SEQ ID NO:1650), CEEFSGC (SEQ ID NO:1651), CLEEFC (SEQ ID NO:1652), CLEEFSC (SEQ ID NO:1653), CLEEFSGC (SEQ ID NO:1654), CVLEEFC (SEQ ID NO:1655), CVLEEFSC (SEQ ID NO:1656), CVLEEFSGC (SEQ ID NO:1657), CFVLEEFC (SEQ ID NO:1658), CFVLEEFSC (SEQ ID NO:1659), CFVLEEFSGC (SEQ ID NO:1660), CMFVLEEFC (SEQ ID NO:1661), CMFVLEEFSC (SEQ ID NO:1662), CMFVLEEFSGC (SEQ ID NO:1663), EEEFK (SEQ ID NO:1664), EEEFSK (SEQ ID NO:1665), EEEFSGK (SEQ ID NO:1666), ELEEFK (SEQ ID NO:1667), ELEEFSK (SEQ ID NO:1668), ELEEFSGK (SEQ ID NO:1669), EVLEEFK (SEQ ID NO:1670), EVLEEFSK (SEQ ID NO:1671), EVLEEFSGK (SEQ ID NO:1672), EFVLEEFK (SEQ ID NO:1673), EFVLEEFSK (SEQ ID NO:1674), EFVLEEFSGK (SEQ ID NO:1675), EMFVLEEFK (SEQ ID NO:1676) EMFVLEEFSK (SEQ ID NO:1677), EMFVLEEFSGK (SEQ ID NO:1678), KEEFD (SEQ ID NO:1679), KEEFSD (SEQ ID NO:1680), KEEFSGD (SEQ ID NO:1681), KLEEFD (SEQ ID NO:1682), KLEEFSD (SEQ ID NO:1683), KLEEFSGD (SEQ ID NO:1684), KVLEEFD (SEQ ID NO:1685), KVLEEFSD (SEQ ID NO:1686), KVLEEFSGD (SEQ ID NO:1687), KFVLEEFD (SEQ ID NO:1688), KFVLEEFSD (SEQ ID NO:1689), KFVLEEFSGD (SEQ ID NO:1690), KMFVLEEFD (SEQ ID NO:1691), KMFVLEEFSD (SEQ ID NO:1692), KMFVLEEFSGD (SEQ ID NO:1693), DEEFK (SEQ ID NO:1694), DEEFSK (SEQ ID NO:1695), DEEFSGK (SEQ ID NO:1696), DLEEFK (SEQ ID NO:1697), DLEEFSK (SEQ ID NO:1698), DLEEFSGK (SEQ ID NO:1699), DVLEEFK (SEQ ID NO:1700), DVLEEFSK (SEQ ID NO:1701), DVLEEFSGK (SEQ ID NO:1702), DFVLEEFK (SEQ ID NO:1703), DFVLEEFSK (SEQ ID NO:1704), DFVLEEFSGK (SEQ ID NO:1705), DMFVLEEFK (SEQ ID NO:1706), DMFVLEEFSK (SEQ ID NO:1707), DMFVLEEFSGK (SEQ ID NO:1708), KEEFE (SEQ ID NO:1709), KEEFSE (SEQ ID NO:1710), KEEFSGE (SEQ ID NO:1711), KLEEFE (SEQ ID NO:1712), KLEEFSE (SEQ ID NO:1713), KLEEFSGE (SEQ ID NO:1714), KVLEEFE (SEQ ID NO:1715), KVLEEFSE (SEQ ID NO:1716), KVLEEFSGE (SEQ ID NO:1717), KFVLEEFE (SEQ ID NO:1718), KFVLEEFSE (SEQ ID NO:1719), KFVLEEFSGE (SEQ ID NO:1720), KMFVLEEFE (SEQ ID NO:1721), KMFVLEEFSE (SEQ ID NO:1722), KMFVLEEFSGE (SEQ ID NO:1723), EEFSG (SEQ ID NO:1724), LEEFS (SEQ ID NO:1725), LEEFSG (SEQ ID NO:1726), VLEEF (SEQ ID NO:1727), VLEEFS (SEQ ID NO:1728), VLEEFSG (SEQ ID NO:1729), FVLEEF (SEQ ID NO:1730), FVLEEFS (SEQ ID NO:1731), FVLEEFSG (SEQ ID NO:1732), MFVLEEF (SEQ ID NO:1733), MFVLEEFS (SEQ ID NO:1734) and MFVLEEFSG (SEQ ID NO:1735).

Representative cyclic peptides comprising a cadherin-12 CAR sequence include: CDETC (SEQ ID NO:1736), CIDETC (SEQ ID NO:1737), CDETTC (SEQ ID NO:1738), CTIDETC (SEQ ID NO:1739), CIDETTC (SEQ ID NO:1740), CTIDETTC (SEQ ID NO:1741), CDETTGC (SEQ ID NO:1742), CIDETTGC (SEQ ID NO:1743), CTIDETTGC (SEQ ID NO:1744), CFTIDETC (SEQ ID NO:1745), CFTIDETTC (SEQ ID NO:1746), CFTIDETTGC (SEQ ID NO:1747), CVFTIDETC (SEQ ID NO:1748), CVFTIDETTC (SEQ ID NO:1749), CVFTIDETTGC (SEQ ID NO:1750), DDETK (SEQ ID NO:1752), DIDETK (SEQ ID NO:1753), DTIDETK (SEQ ID NO:1754), DFTIDETK (SEQ ID NO:1755), DVFTIDETK (SEQ ID NO:1756), EDETK (SEQ ID NO:1757), EIDETK (SEQ ID NO:1758), ETIDETK (SEQ ID NO:1759), EFTIDETK (SEQ ID NO:1760), EVFTIDETK (SEQ ID NO:1761), KDETD (SEQ ID NO:1762), KIDETD (SEQ ID NO:1763), KDETTD (SEQ ID NO:1764), KTIDETD (SEQ ID NO:1765), KIDETTD (SEQ ID NO:1766), KTIDETTD (SEQ ID NO:1767), KDETTGD (SEQ ID NO:1768), KIDETTGD (SEQ ID NO:1769), KTIDETTGD (SEQ ID NO:1770), KFTIDETD (SEQ ID NO:1771), KFTIDETTD (SEQ ID NO:1772), KFTIDETTGD (SEQ ID NO:1773), KVFTIDETD (SEQ ID NO:1774), KVFTIDETTD (SEQ ID NO:1775), KVFTIDETTGD (SEQ ID NO:1776), DDETTK (SEQ ID NO:1751), DIDETTK (SEQ ID NO:1777), DTIDETTK (SEQ ID NO:3934), DFTIDETTK (SEQ ID NO:3935), DVFTIDETTK (SEQ ID NO:3936), DDETTGK (SEQ ID NO:3937), DIDETTGK (SEQ ID NO:3938), DTIDETTGK (SEQ ID NO:3939), DFTIDETTGK (SEQ ID NO:3940), DVFTIDETTGK (SEQ ID NO:3941), EDETTK (SEQ ID NO:3942), EIDETTK (SEQ ID NO:3943), ETIDETTK (SEQ ID NO:3944), EFTIDETTK (SEQ ID NO:3945), DVFTIDETTK (SEQ ID NO:3946), EDETTGK (SEQ ID NO:3947), EIDETTGK (SEQ ID NO:3948), ETIDETTGK (SEQ ID NO:3949), EFTIDETTGK (SEQ ID NO:3950), EVFTIDETTGK (SEQ ID NO:3951), IDETT (SEQ ID NO:1778), TIDETT (SEQ ID NO:1779), DETTG (SEQ ID NO:1780), IDETTG (SEQ ID NO:1781), KDETE (SEQ ID NO:1782), KIDETE (SEQ ID NO:1783), KDETTE (SEQ ID NO:1784), KTIDETE (SEQ ID NO:1785), KIDETTE (SEQ ID NO:1786), KTIDETTE (SEQ ID NO:1787), KDETTGE (SEQ ID NO:1788), KIDETTGE (SEQ ID NO:1789), KTIDETTGE (SEQ ID NO:1790), KFTIDETE (SEQ ID NO:1791), KFTIDETTE (SEQ ID NO:1792), KFTIDETTGE (SEQ ID NO:1793), KVFTIDETE (SEQ ID NO:1794), KIFTIDETTE (SEQ ID NO:1795), KVFTIDETTGE (SEQ ID NO:1796), CDPKC (SEQ ID NO:1797), CDPKTC (SEQ ID NO:1798), CDPKTGC (SEQ ID NO:1799), CIDPKC (SEQ ID NO:1800), CIDPKTC (SEQ ID NO:1801), CIDPKTGC (SEQ ID NO:1802), CSIDPKC (SEQ ID NO:1803), CSIDPKTC (SEQ ID NO:1804), CSIDPKTGC (SEQ ID NO:1805), CFSIDPKC (SEQ ID NO:1806), CFSIDPKTC (SEQ ID NO:1807), CFSIDPKTGC (SEQ ID NO:1808), CYFSIDPKC (SEQ ID NO:1809), CYFSIDPKTC (SEQ ID NO:1810), CYFSIDPKTGC (SEQ ID NO:1811), EDPKK (SEQ ID NO:1812), EDPKTK (SEQ ID NO:1813), EDPKTGK (SEQ ID NO:1814), EIDPKK (SEQ ID NO:1815), EIDPKTK (SEQ ID NO:1816), EIDPKTGK (SEQ ID NO:1817), ESIDPKK (SEQ ID NO:1818), ESIDPKTK (SEQ ID NO:1819), ESIDPKTGK (SEQ ID NO:1820), EFSIDPKK (SEQ ID NO:1821), EFSIDPKTK (SEQ ID NO:1822), EFSIDPKTGK (SEQ ID NO:1823), EYFSIDPKK (SEQ ID NO:1824), EYFSIDPKTK (SEQ ID NO:1825), EYFSIDPKTGK (SEQ ID NO:1826), KDPKD (SEQ ID NO:1827), KDPKTD (SEQ ID NO:1828), KDPKTGD (SEQ ID NO:1829), KIDPKD (SEQ ID NO:1830), KIDPKTD (SEQ ID NO:1831), KIDPKTGD (SEQ ID NO:1832), KSIDPKD (SEQ ID NO:1833), KSIDPKTD (SEQ ID NO:1834), KSIDPKTGD (SEQ ID NO:1835), KFSIDPKD (SEQ ID NO:1836), KFSIDPKTD (SEQ ID NO:1837), KFSIDPKTGD (SEQ ID NO:1838), KYFSIDPKD (SEQ ID NO:1839), KYFSIDPKTD (SEQ ID NO:1840), KYFSIDPKTGD (SEQ ID NO:1841), DDPKK (SEQ ID NO:1842), DDPKTK (SEQ ID NO:1843), DDPKTGK (SEQ ID NO:1844), DIDPKK (SEQ ID NO:1845), DIDPKTK (SEQ ID NO:1846), DIDPKTGK (SEQ ID NO:1847), DSIDPKK (SEQ ID NO:1848), DSIDPKTK (SEQ ID NO:1849), DSIDPKTGK (SEQ ID NO:1850), DFSIDPKK (SEQ ID NO:1851), DFSIDPKTK (SEQ ID NO:1852), DFSIDPKTGK (SEQ ID NO:1853), DYFSIDPKK (SEQ ID NO:1854), DYFSIDPKTK (SEQ ID NO:1855), DYFSIDPKTGK (SEQ ID NO:1856), KDPKE (SEQ ID NO:1857), KDPKTE (SEQ ID NO:1858), KDPKTGE (SEQ ID NO:1859), KIDPKE (SEQ ID NO:1860), KIDPKTE (SEQ ID NO:1861), KIDPKTGE (SEQ ID NO:1862), KSIDPKE (SEQ ID NO:1863), KSIDPKTE (SEQ ID NO:1864), KSIDPKTGE (SEQ ID NO:1865), KFSIDPKE (SEQ ID NO:1866), KFSIDPKTE (SEQ ID NO:1867), KFSIDPKTGE (SEQ ID NO:1868), KYFSIDPKE (SEQ ID NO:1869), KYFSIDPKTE (SEQ ID NO:1870), KYFSIDPKTGE (SEQ ID NO:1871), DPKTG (SEQ ID NO:1872), IDPKT (SEQ ID NO:1873), IDPKTG (SEQ ID NO:1874), SIDPK (SEQ ID NO:1875), SIDPKT (SEQ ID NO:1876), SIDPKTG (SEQ ID NO:1877), FSIDPK (SEQ ID NO:1878), FSIDPKT (SEQ ID NO:1879), FSIDPKTG (SEQ ID NO:1880), YFSIDPK (SEQ ID NO:1881), YFSIDPKT (SEQ ID NO:1882) and YFSIDPKTG (SEQ ID NO:1883).

Representative cyclic peptides comprising a cadherin-14 CAR sequence include: CDDTC (SEQ ID NO:1884), CIDDTC (SEQ ID NO:1885), CDDTTC (SEQ ID NO:1886), CIIDDTC (SEQ ID NO:1887), CIDDTTC (SEQ ID NO:1888), CIIDDTTC (SEQ ID NO:1889), CDDTTGC (SEQ ID NO:1890), CIDDTTGC (SEQ ID NO:1891), CIIDDTTGC (SEQ ID NO:1892), CFIIDDTC (SEQ ID NO:1893), CFIIDDTTC (SEQ ID NO:1894), CFIIDDTTGC (SEQ ID NO:1895), CIFIIDDTC (SEQ ID NO:1896), CIFIIDDTTC (SEQ ID NO:1897), CIFIIDDTTGC (SEQ ID NO:1898), EDDTTK (SEQ ID NO:1899), EIDDTTK (SEQ ID NO:3952), EIIDDTTK (SEQ ID NO:3953), EFIIDDTTK (SEQ ID NO:3954), EIFIIDDTTK (SEQ ID NO:3955), EDDTTGK (SEQ ID NO:3956), EIDDTTGK (SEQ ID NO:3957), EIIDDTTGK (SEQ ID NO:3958), EFIIDDTTGK (SEQ ID NO:3959), EIFIIDDTTGK (SEQ ID NO:3960), DDDTTK (SEQ ID NO:3961), DIDDTTK (SEQ ID NO:3962), DFIIDDTTK (SEQ ID NO:3963), DIFIIDDTTK (SEQ ID NO:3964), DDDTTGK (SEQ ID NO:3965), DIDDTTGK (SEQ ID NO:3966), DIIDDTTGK (SEQ ID NO:3967), DFIIDDTTGK (SEQ ID NO:3968), DIFIIDDTTGK (SEQ ID NO:3969), DDDTK (SEQ ID NO:1900), DIDDTNK (SEQ ID NO:1901), DIIDDTK (SEQ ID NO:1902), DFIIDDTK (SEQ ID NO:1903), DIFIIDDTK (SEQ ID NO:1904), EDDTK (SEQ ID NO:1905), EIDDTK (SEQ ID NO:1906), EIIDDTK (SEQ ID NO:1907), EFIIDDTK (SEQ ID NO:1908), EIFIIDDTK (SEQ ID NO:1909), KDDTD (SEQ ID NO:1910), KIDDTD (SEQ ID NO:1911), KDDTTD (SEQ ID NO:1912), KIIDDTD (SEQ ID NO:1913), KIDDTTD (SEQ ID NO:1914), KIIDDTTD (SEQ ID NO:1915), KDDTTGD (SEQ ID NO:1916), KIDDTTGD (SEQ ID NO:1917), KIIDDTTGD (SEQ ID NO:1918), KFIIDDTD (SEQ ID NO:1919), KFIIDDTTD (SEQ ID NO:1920), KFIIDDTTGD (SEQ ID NO:1921), KIFIIDDTD (SEQ ID NO:1922), KIFIIDDTTD (SEQ ID NO:1923), KIFIIDDTTGD (SEQ ID NO:1924), DDTT (SEQ ID NO:1925), IDDTT (SEQ ID NO:1926), IIDDTT (SEQ ID NO:1927), DDTTG (SEQ ID NO:1928), IDDTTG (SEQ ID NO:1929) KDDTE (SEQ ID NO:1930), KIDDTE (SEQ ID NO:1931), KDDTTE (SEQ ID NO:1932), KIIDDTE (SEQ ID NO:1933), KIDDTTE (SEQ ID NO:1934), KIIDDTTE (SEQ ID NO:1935), KDDTTGE (SEQ ID NO:1936), KIDDTTGE (SEQ ID NO:1937), KIIDDTTGE (SEQ ID NO:1938), KFIIDDTE (SEQ ID NO:1939), KFIIDDTE (SEQ ID NO:1940), KFIIDDTTGE (SEQ ID NO:1941), KIFIIDDTE (SEQ ID NO:1942), KIFIIDDTTE (SEQ ID NO:1943), KIFIIDDTTGE (SEQ ID NO:1944), CDPKC (SEQ ID NO:1945), CVDPKC (SEQ ID NO:1946), CVDPKTC (SEQ ID NO:1947), CVDPKTGC (SEQ ID NO:1948), CSVDPKC (SEQ ID NO:1949), CSVDPKTC (SEQ ID NO 1950), CSVDPKTGC (SEQ ID NO:1951), CFSVDPKC (SEQ ID NO:1952), CFSVDPKTC (SEQ ID NO:1953), CFSVDPKTGC (SEQ ID NO:1954), CYFSVDPKC (SEQ ID NO:1955), CYFSVDPKTC (SEQ ID NO:1956), CYFSVDPKTGC (SEQ ID NO:1957), CDPKTC (SEQ ID NO:3970), CDPKTGC (SEQ ID NO:3971), CDANC (SEQ ID NO:1958), CDANTC (SEQ ID NO:1959), CDANTGC (SEQ ID NO:1960), CIDANTC (SEQ ID NO:1961), CIDANTGC (SEQ ID NO:1962), CNIDANTC (SEQ ID NO:1963), CNIDANTGC (SEQ ID NO:1964), CFNIDANTC (SEQ ID NO:1965), CFNIDANTGC (SEQ ID NO:1966), CFFNIDANC (SEQ ID NO:1967), CFFNIDANTC (SEQ ID NO:1968), CFFNIDANTGC (SEQ ID NO:1969), CIDANC (SEQ ID NO:3972), CNIDANC (SEQ ID NO:3973), CFNIDANC (SEQ ID NO:.3974), EDPKK (SEQ ID NO:1970), EDPKTK (SEQ ID NO:1971), EDPKTGK (SEQ ID NO:1972), EVDPKK (SEQ ID NO:1973), EVDPKTK (SEQ ID NO:1974), EVDPKTGK (SEQ ID NO:1975), ESVDPKK (SEQ ID NO:1976), ESVDPKTK (SEQ ID NO:1977), ESVDPKTGK (SEQ ID NO:1978), EFSVDPKK (SEQ ID NO:1979), EFSVDPKTK (SEQ ID NO:1980), EFSVDPKTGK (SEQ ID NO:1981), EYFSVDPKK (SEQ ID NO:1982), EYFSVDPKTK (SEQ ID NO:1983), EYFSVDPKTGK (SEQ ID NO:1984), EDANK (SEQ ID NO:1985), EDANTK (SEQ ID NO:1986), EDANTGK (SEQ ID NO:1987), EIDANTK (SEQ ID NO:1988), EIDANTGK (SEQ ID NO:1989), ENIDANTK (SEQ ID NO:1990), ENIDANTGK (SEQ ID NO:1991), EFNIDANTK (SEQ ID NO:1992), EFNIDANTGK (SEQ ID NO:1993), EFFNIDANK (SEQ ID NO:1994), EFFNIDANTK (SEQ ID NO:1995), EFFNIDANTGK (SEQ ID NO:1996), EIDANK (SEQ ID NO:3975), ENIDANK (SEQ ID NO:3976), EFNIDANK (SEQ ID NO:3977), KVDPKD (SEQ ID NO:1997), KVDPKTD (SEQ ID NO:1998), KVDPKTGD (SEQ ID NO:1999), KSVDPKD (SEQ ID NO:2000), KSVDPKTD (SEQ ID NO:2001), KSVDPKTGD (SEQ ID NO:2002), KFSVDPKD (SEQ ID NO:2003), KFSVDPKTD (SEQ ID NO:2004), KFSVDPKTGD (SEQ ID NO:2005), KYFSVDPKD (SEQ ID NO:2006), KYFSVDPKTD (SEQ ID NO:2007), KYFSVDPKTGD (SEQ ID NO:2008), KDPKD (SEQ ID NO:3978), KDPKTD (SEQ ID NO:3979), KDPKTGD (SEQ ID NO:3980), KDAND (SEQ ID NO:3981), KIDAND (SEQ ID NO:3982), KNIDAND (SEQ ID NO:3983), KDANTD (SEQ ID NO:2009), KDANTGD (SEQ ID NO:2010), KIDANTD (SEQ ID NO:2011), KIDANTGD (SEQ ID NO:2012), KNIDANTD (SEQ ID NO:2013), KNIDANTGD (SEQ ID NO:2014), KFNIDANTD (SEQ ID NO:2015), KFNIDANTGD (SEQ ID NO:2016), KFFNIDAND (SEQ ID NO:2017), KFFNIDANTD (SEQ ID NO:2018), KFFNIDANTGD (SEQ ID NO:2019), DDPKK (SEQ ID NO:2020), DDPKTK (SEQ ID NO:2021), DDPKTGK (SEQ ID NO:2022), DVDPKK (SEQ ID NO:2023), DVDPKTK (SEQ ID NO:2024), DVDPKTGK (SEQ ID NO:2025), DSVDPKK (SEQ ID NO:2026), DSVDPKTK (SEQ ID NO:2027), DSVDPKTGK (SEQ ID NO:2028), DFSVDPKK (SEQ ID NO:2029), DFSVDPKTK (SEQ ID NO:2030), DFSVDPKTGK (SEQ ID NO:2031), DYFSVDPKK (SEQ ID NO:2032), DYFSVDPKTK (SEQ ID NO::2033), DYFSVDPKTGK (SEQ ID NO:2034), DDANK (SEQ ID NO:2035), DDANTK (SEQ ID NO:2036), DDANTGK (SEQ ID NO:2037), DIDANTK (SEQ ID NO:2038), DIDANTGK (SEQ ID NO:2039), DNIDANTK (SEQ ID NO:2040), DNIDANTGK (SEQ ID NO:2041), DFNIDANTC (SEQ ID NO:2042), DFNIDANTGK (SEQ ID NO:2043), DFFNIDANK (SEQ ID NO:2044), DFFNIDANTK (SEQ ID NO:2045), DFFNIDANTGK (SEQ ID NO:2046), DIDANK (SEQ ID NO:3984), DNIDANK (SEQ ID NO:3985), DFNIDANK (SEQ ID NO:3986), DFNIDANTK (SEQ ID NO:3987), KDPKE (SEQ ID NO:3988), KDPKTE (SEQ ID NO:3989), KDPKTGE (SEQ ID NO:3990), KVDPKE (SEQ ID NO:2047), KVDPKTE (SEQ ID NO:2048), KVDPKTGE (SEQ ID NO:2049), KSVDPKE (SEQ ID NO:2050), KSVDPKTE (SEQ ID NO:2051), KSVDPKTGE (SEQ ID NO:2052), KFSVDPKE (SEQ ID NO:2053), KFSVDPKTE (SEQ ID NO:2054), KFSVDPKTGE (SEQ ID NO:2055), KYFSVDPKE (SEQ ID NO:2056), KYFSVDPKTE (SEQ ID NO:2057), KYFSVDPKTGE (SEQ ID NO:2058), KDANE (SEQ ID NO:2059), KDANTE (SEQ ID NO:2060), KDANTGE (SEQ ID NO:2061), KIDANTE (SEQ ID NO:2062), KIDANTGE (SEQ ID NO:2063), KNIDANTE (SEQ ID NO:2064), KNIDANTGE (SEQ ID NO:2065), KFNIDANTE (SEQ ID NO:2066), KFNIDANTGE (SEQ ID NO:2067), KFFNIDANE (SEQ ID NO:2068), KFFNIDANTE (SEQ ID NO:2069), KFFNIDANTGE (SEQ ID NO:2070), KIDANE (SEQ ID NO:3991), KNIDANE (SEQ ID NO:3992), KFNIDANE (SEQ ID NO:3993), VDPKT (SEQ ID NO:2071), VDPKTG (SEQ ID NO:2072), SVDPK (SEQ ID NO:2073), SVDPKT (SEQ ID NO:2074), SVDPKTG (SEQ ID NO:2075), FSVDPK (SEQ ID NO:2076), FSVDPKT (SEQ ID NO:2077), FSVDPKTG (SEQ ID NO:2078), YFSVDPK (SEQ ID NO:2079), YFSVDPKT (SEQ ID NO:2080), YFSVDPKTG (SEQ ID NO:2081), DANTG (SEQ ID NO:2082), IDANT (SEQ ID NO:2083), IDANTG (SEQ ID NO:2084), NIDANT (SEQ ID NO:2085), NIDANTG (SEQ ID NO:2086), FNIDANT (SEQ ID NO:2087), FNIDANTG (SEQ ID NO:2088), FFNIDAN (SEQ ID NO:2089), FFNIDANT (SEQ ID NO:2090), and FFNIDANTG (SEQ ID NO:2091).

Representative cyclic peptides comprising a cadherin-15 CAR sequence include: CDKFC (SEQ ID NO:2092), CIDKFC (SEQ ID NO:2093), CDKFTC (SEQ ID NO:2094), CSIDKFC (SEQ ID NO:2095), CIDKFTC (SEQ ID NO:2096), CSIDKFTC (SEQ ID NO:2097), CDKFTGC (SEQ ID NO:2098), CIDKFTGC (SEQ ID NO:2099), CSIDKFTGC (SEQ ID NO:2100), CFSIDKFC (SEQ ID NO:2101), CFSIDKFTC (SEQ ID NO:2102), CFSIDKFTGC (SEQ ID NO:2103), CVFSIDKFC (SEQ ID NO:2104), CVFSIDKFTC (SEQ ID NO:2105), CVFSIDKFTGC (SEQ ID NO:2106), DDKFK (SEQ ID NO:2108), DIDKFK (SEQ ID NO:2109), DSIDKFK (SEQ ID NO:2110), DFSIDKFK (SEQ ID NO:2111), DVFSIDKFK (SEQ ID NO::2112), DDKFTK (SEQ ID NO:2107), DIDKFTK (SEQ ID NO:2133), DSIDKFTK (SEQ ID NO:3994), DFSIDKFTK (SEQ ID NO:3995), DVFSIDKFTK (SEQ ID NO:3996), DDKTGK (SEQ ID NO:3997), DIDKFTGK (SEQ ID NO:3998), DSIDKFTGK (SEQ ID NO:3999), DFSIDKFTGK (SEQ ID NO:4000), DVFSIDKFTGK (SEQ ID NO:4001), EDKFTK (SEQ ID NO:4002), EIDKFTK (SEQ ID NO:4003), ESIDKFTK (SEQ ID NO:4004), EFSIDKFTK (SEQ ID NO:4005), EVFSIDKFTK (SEQ ID NO:4006), EDKFTGK (SEQ ID NO:4007), EIDKFTGK (SEQ ID NO:4008), EFSIDKFTGK (SEQ ID NO:4009), EVFSIDKFTGK (SEQ ID NO:4010), EDKFK (SEQ ID NO:2113), EIDKFK (SEQ ID NO:2114), ESIDKFK (SEQ ID NO:2115), EFSIDKFK (SEQ ID NO:2116), EVFSIDKFK (SEQ ID NO:2117), KDKFD (SEQ ID NO:2118), KIDKFD (SEQ ID NO:2119), KDKFTD (SEQ ID NO:2120), KSIDKFD (SEQ ID NO:2121), KIDKFTD (SEQ ID NO:2122), KSIDKFTD (SEQ ID NO:2123), KDKFTGD (SEQ ID NO:2124), KIDKFTGD (SEQ ID NO:2125), KSIDKFTGD (SEQ ID NO:2126), KFSIDKFD (SEQ ID NO:2127), KFSIDKFTD (SEQ ID NO:2128), KFSIDKFTGD (SEQ ID NO:2129), KVFSIDKFD (SEQ ID NO:2130), KVFSIDKFTD (SEQ ID NO:2131), KVFSIDKFTGD (SEQ ID NO:2132), IDKFT (SEQ ID NO:2134), SIDKFT (SEQ ID NO:2135), DKFTG (SEQ ID NO:2136), IDKFTG (SEQ ID NO:2137) KDKFE (SEQ ID NO:2138), KIDKFE (SEQ ID NO:2139), KDKFTE (SEQ ID NO:2140), KSIDKFE (SEQ ID NO:2141), KIDKFTE (SEQ ID NO:2142), KSIDKFTE (SEQ ID NO:2143), KDKFTGE (SEQ ID NO:2144), KIDKFTGE (SEQ ID NO:2145), KSIDKFTGE (SEQ ID NO:2146), KFSIDKFE (SEQ ID NO:2147), KFSIDKFTE (SEQ ID NO:2148), KFSIDKFTGE (SEQ ID NO:2149), KVFSIDKFE (SEQ ID NO:2150), KIFSIDKFTE (SEQ ID NO:2151), KVFSIDKFTGE (SEQ ID NO:2152), CDELC (SEQ ID NO:2153), CDELTC (SEQ ID NO:2154), CDELTGC (SEQ ID NO:2155), CIDELC (SEQ ID NO:2156), CIDELTC (SEQ ID NO:2157), CIDELTGC (SEQ ID NO:2158), CSIDELC (SEQ ID NO:2159), CSIDELTC (SEQ ID NO:2160), CSIDELTGC (SEQ ID NO:2161), CFSIDELC (SEQ ID NO:2162), CFSIDELTC (SEQ ID NO:2163), CFSIDELTGC (SEQ ID NO:2164), CLFSIDELC (SEQ ID NO:2165), CLFSIDELTC (SEQ ID NO:2166), CLFSIDELTGC (SEQ ID NO:2167), EDELCK (SEQ ID NO:2168), EDELTK (SEQ ID NO:2169), EDELTGK (SEQ ID NO:2170), EIDELK (SEQ ID NO:2171), EIDELTK (SEQ ID NO:2172), EIDELTGK (SEQ ID NO:2173), ESIDELK (SEQ ID NO:2174), ESIDELTK (SEQ ID NO:2175), ESIDELTGK (SEQ ID NO:2176), EFSIDELK (SEQ ID NO:2177), EFSIDELTK (SEQ ID NO:2178), EFSIDELTGK (SEQ ID NO:2179), ELFSIDELK (SEQ ID NO:2180), ELFSIDELTK (SEQ ID NO:2181), ELFSIDELTGK (SEQ ID NO:2182), KDELD (SEQ ID NO:2183), KDELTD (SEQ ID NO:2184), KDELTGD (SEQ ID NO:2185), KIDELD (SEQ ID NO:2186), KIDELTD (SEQ ID NO:2187), KIDELTGD (SEQ ID NO:2188), KSIDELD (SEQ ID NO:2189), KSIDELTD (SEQ ID NO:2190), KSIDELTGD (SEQ ID NO:2191), KFSIDELD (SEQ ID NO:2192), KFSIDELTD (SEQ ID NO:2193), KFSIDELTGD (SEQ ID NO:2194), KLFSIDELD (SEQ ID NO:2195), KLFSIDELTD (SEQ ID NO:2196), KLFSIDELTGD (SEQ ID NO:2197), DDELK (SEQ ID NO:2198), DDELTK (SEQ ID NO:2199), DDELTGK (SEQ ID NO:2200), DIDELK (SEQ ID NO:2201), DIDELTK (SEQ ID NO:2202), DIDELTGK (SEQ ID NO:2203), DSIDELK (SEQ ID NO:2204), DSIDELTK (SEQ ID NO:2205), DSIDELTGK (SEQ ID NO:2206), DFSIDELK (SEQ ID NO:2207), DFSIDELTK (SEQ ID NO:2208), DFSIDELTGK (SEQ ID NO:2209), DLFSIDELK (SEQ ID NO:2210), DLFSIDELTK (SEQ ID NO:2211), DLFSIDELTGK (SEQ ID NO:2212), KDELE (SEQ ID NO:2213), KDELTE (SEQ ID NO:2214), KDELTGE (SEQ ID NO:2215), KIDELE (SEQ ID NO:2216), KIDELTE (SEQ ID NO:2217), KIDELTGE (SEQ ID NO:2218), KSIDELE (SEQ ID NO:2219), KSIDELTE (SEQ ID NO:2220), KSIDELTGE (SEQ ID NO:2221), KFSIDELE (SEQ ID NO:2222), KFSIDELTE (SEQ ID NO:2223), KFSIDELTGE (SEQ ID NO:2224), KLFSIDELE (SEQ ID NO:2225), KLFSIDELTE (SEQ ID NO:2226), KLFSIDELTGE (SEQ ID NO:2227), DELTG (SEQ ID NO:2228), IDELT (SEQ ID NO:2229), IDELTG (SEQ ID NO:2230), SIDEL (SEQ ID NO:2231), SIDELT (SEQ ID NO:2232), SIDELTG (SEQ ID NO:2233), FSIDEL (SEQ ID NO:2234), FSIDELT (SEQ ID NO:2235), FSIDELTG (SEQ ID NO:2236), LFSIDEL (SEQ ID NO:2237), LFSIDELT (SEQ ID NO:2238) and LFSIDELTG. (SEQ ID NO:2239).

Representative cyclic peptides comprising a T-cadherin CAR sequence include: CNENC (SEQ ID NO:2240), CINENC (SEQ ID NO:2241), CNENTC (SEQ ID NO:2242), CRINENC (SEQ ID NO:2243), CINENTC (SEQ ID NO:2244), CRINENTC (SEQ ID NO:2245), CNENTGC (SEQ ID NO:2246), CINENTGC (SEQ ID NO:2247), CRINENTGC (SEQ ID NO:2248), CFRINENC (SEQ ID NO:2249), CFRINENTC (SEQ ID NO:2250), CFRINENTGC (SEQ ID NO:2251), CIFRINENC (SEQ ID NO:2252), CIFRINENTC (SEQ ID NO:2253), CIFRINENTGC (SEQ ID NO:2254), DNENK (SEQ ID NO:2255), DINENK (SEQ ID NO:2256), DRINENK (SEQ ID NO:2257), DFRINENK (SEQ ID NO:2258), DIFRINENK (SEQ ID NO:2259), ENENK (SEQ ID NO:2260), EINENK (SEQ ID NO:2261), ERINENK (SEQ ID NO:2262), EFRINENK (SEQ ID NO:2263), EIFRINENK (SEQ ID NO:2264), KNEND (SEQ ID NO:2265), KINEND (SEQ ID NO:2266), KNENTD (SEQ ID NO:2267), KRINEND (SEQ ID NO:2268), KINENTD (SEQ ID NO:2269), KRINENTD (SEQ ID NO:2270), KNENTGD (SEQ ID NO:2271), KINENTGD (SEQ ID NO:2272), KRINENTGD (SEQ ID NO:2273), KFRINEND (SEQ ID NO:2274), KFRINENTD (SEQ ID NO:2275), KFRINENTGD (SEQ ID NO:2276), KIFRINEND (SEQ ID NO:2277), KIFRINENTD (SEQ ID NO:2278), KIFRINENTGD (SEQ ID NO:2279), DNENTK (SEQ ID NO:4011), DINENTK (SEQ ID NO:4012), DRINENTK (SEQ ID NO:4013), DFRINENTK (SEQ ID NO:4014), DIFRINENTK (SEQ ID NO:4015), DNENTGK (SEQ ID NO:4016), DINENTGK (SEQ ID NO:4017), DRINENTGK (SEQ ID NO:4018), DFRINENTGK (SEQ ID NO:4019), DIFRINENTGK (SEQ ID NO:4020), ENENTK (SEQ ID NO:4021), EINENTK (SEQ ID NO:4022), ERINENTK (SEQ ID NO:4023), EFRINENTK (SEQ ID NO:4024), EIFRINENTK (SEQ ID NO:4025), ENENTGK (SEQ ID NO:4026), EINENTGK (SEQ ID NO:4027), ERINENTGK (SEQ ID NO:4028), EFRINENTGK (SEQ ID NO:4029), EIFRINENTGK (SEQ ID NO:4030), VNENTG (SEQ ID NO:4031), RINENTG (SEQ ID NO:4032), FRINEN (SEQ ID NO:4033), FRINENT (SEQ ID NO:4034), FRINENTG (SEQ ID NO:4035), IFRINEN (SEQ ID NO:4036), IFRINENT (SEQ ID NO:4037), IFRINENTG (SEQ ID NO:4038), VNENT (SEQ ID NO:2280), INENT (SEQ ID NO:2281), RINENT (SEQ ID NO:2282), NENTG (SEQ ID NO:2283), INENTG (SEQ ID NO:2284) KNENE (SEQ ID NO:2285), KINENE (SEQ ID NO:2286), KNENTE (SEQ ID NO:2287), KRINENE (SEQ ID NO:2288), KINENTE (SEQ ID NO:2289), KRINENTE (SEQ ID NO:2290), KNENTGE (SEQ ID NO:2291), KINENTGE (SEQ ID NO:2292), KRINENTGE (SEQ ID NO:2293), KFRINENE (SEQ ID NO:2294), KFRINENTE (SEQ ID NO:2295), KFRINENTGE (SEQ ID NO:2296), KIFRINENE (SEQ ID NO:2297), KIFRINENTE (SEQ ID NO:2298) and KIFRINENTGE (SEQ ID NO:2299).

Representative cyclic peptides comprising a PB-cadherin CAR sequence include: CEEYC (SEQ ID NO:2300), CEEYTC (SEQ ID NO:2301), CEEYTG (SEQ ID NO:2302), CVEEYC (SEQ ID NO:2303), CVEEYTC (SEQ ID NO:2304), CVEEYTGC (SEQ ID NO:2305), CVVEEYC (SEQ ID NO:2306), CVVEEYTC (SEQ ID NO:2307), CVVEEYTGC (SEQ ID NO:2308), CFVVEEYC (SEQ ID NO:2309), CFVEEYTC (SEQ ID NO:2310), CFVEEYTGC (SEQ ID NO:2311), CFFVVEEYC (SEQ ID NO:2312), CFFVVEEYTC (SEQ ID NO:2313), CFFVVEEYTGC (SEQ ID NO:2314), CLIDELC (SEQ ID NO:2315), CLIDELTC (SEQ ID NO:2316), CLIDELTGC (SEQ ID NO:2317), CFLIDELC (SEQ ID NO:2318), CFLIDELTC (SEQ ID NO:2319), CFLIDELTGC (SEQ ID NO:2320), CIFLIDELC (SEQ ID NO:2321), CIFLIDELTC (SEQ ID NO:2322), CIFLIDELTGC (SEQ ID NO:2323), CDELC (SEQ ID NO:4039), CDELTC (SEQ ID NO:4040), CDELTGC (SEQ ID NO:4041), CIDELC (SEQ ID NO:4042), CIDELTC (SEQ ID NO:4043), CIDELTGC (SEQ ID NO:4044), CDPKC (SEQ ID NO:4045), CDPKTC (SEQ ID NO:4046), CDPKTGC (SEQ ID NO:4047), CVDPKC (SEQ ID NO:4048), CVDPKTC (SEQ ID NO:4049), CVDPKTGC (SEQ ID NO:4050), CTVDPKC (SEQ ID NO:2324), CTVDPKTC (SEQ ID NO:2325), CTVDPKTGC (SEQ ID NO:2326), CFTVDPKC (SEQ ID NO:2327), CFTVDPKTC (SEQ ID NO:2328), CFTVDPKTGC (SEQ ID NO:2329), CHFTVDPKC (SEQ ID NO:2330), CHFTVDPKTC (SEQ ID NO:2331), CHFTVDPKTGC (SEQ ID NO:2332), CDADC (SEQ ID NO:2333), CDADTC (SEQ ID NO:2334), CDADTGC (SEQ ID NO:2335), CIDADC (SEQ ID NO:2336), CIDADTC (SEQ ID NO:2337), CIDADTGC (SEQ ID NO:2338), CDIDADC (SEQ ID NO:2339), CDIDADTC (SEQ ID NO:2340), CDIDADTGC (SEQ ID NO:2341), CFDIDADC (SEQ ID NO:2342), CFDIDADTC (SEQ ID NO:2343), CFDIDADTGC (SEQ ID NO:2344), CIFDIDADC (SEQ ID NO:2345), CIFDIDADTC (SEQ ID NO:2346), CIFDIDADTGC (SEQ ID NO:2347), EEEYK (SEQ ID NO:2348), EEEYTK (SEQ ID NO:2349), EEEYTGK (SEQ ID NO:2350), EVEEYK (SEQ ID NO:2351), EVEEYTK (SEQ ID NO:2352), EVEEYTGK (SEQ ID NO:2353), EVVEEYK (SEQ ID NO:2354), EVVEEYTK (SEQ ID NO:2355), EVVEEYTGK (SEQ ID NO:2356), EFVVEEYK (SEQ ID NO:2357), EFVEEYTK (SEQ ID NO:2358), EFVEEYTGK (SEQ ID NO:2359), EFFVVEEYK (SEQ ID NO:2360), EFFVVEEYTK (SEQ ID NO:2361), EFFVVEEYTGK (SEQ ID NO:2362), EDELK (SEQ ID NO:2363), EDELTK (SEQ ID NO:2364), EDELTGK (SEQ ID NO:2365), EIDELK (SEQ ID NO:2366), EIDELTK (SEQ ID NO:2367), EIDELTGK (SEQ ID NO:2368), ELIDELK (SEQ ID NO:2369), ELIDELTK (SEQ ID NO:2370), ELIDELTGK (SEQ ID NO:2371), EFLIDELK (SEQ ID NO:2372), EFLIDELTK (SEQ ID NO:2373), EFLIDELTGK (SEQ ID NO:2374), EIFLIDELK (SEQ ID NO:2375), EIFLIDELTK (SEQ ID NO:2376), EIFLIDELTGK (SEQ ID NO:2377), EDPKK (SEQ ID NO:2378), EDPKTK (SEQ ID NO:2379), EDPKTGK (SEQ ID NO:2380), EVDPKK (SEQ ID NO:2381), EVDPKTK (SEQ ID NO:2382), EVDPKTGK (SEQ ID NO:2383), ETVDPKK (SEQ ID NO:2384), ETVDPKTK (SEQ ID NO:2385), ETVDPKTGK (SEQ ID NO:2386), EFTVDPKK (SEQ ID NO:2387), EFTVDPKTK (SEQ ID NO:2388), EFTVDPKTGK (SEQ ID NO:2389), EHFTVDPKK (SEQ ID NO:2390), EHFTVDPKTK (SEQ ID NO:2391), EHFTVDPKTGK (SEQ ID NO:2392), EDADK (SEQ ID NO:2393), EDADTK (SEQ ID NO:2394), EDADTGK (SEQ ID NO:2395), EIDADK (SEQ ID NO:2396), EIDADTK (SEQ ID NO:2397), EIDADTGK (SEQ ID NO:2398), EDIDADK (SEQ ID NO:2399), EDIDADTK (SEQ ID NO:2400), EDIDADTGK (SEQ ID NO:2401), EFDIDADK (SEQ ID NO:2402), EFDIDADTK (SEQ ID NO:2403), EFDIDADTGK (SEQ ID NO:2404), EIFDIDADK (SEQ ID NO:2405), EIFDIDADTK (SEQ ID NO:2406), EIFDIDADTGK (SEQ ID NO:2407), KEEYD (SEQ ID NO:2408), KEEYTD (SEQ ID NO:2409), KEEYTGD (SEQ ID NO:2410), KVEEYD (SEQ ID NO:2411), KVEEYTD (SEQ ID NO:2412), KVEEYTGD (SEQ ID NO:2413), KVVEEYD (SEQ ID NO:2414), KVVEEYTD (SEQ ID NO:2415), KVVEEYTGD (SEQ ID NO:2416), KFVVEEYD (SEQ ID NO:2417), KFVEEYTD (SEQ ID NO:2418), KFVEEYTGD (SEQ ID NO:2419), KFFVVEEYD (SEQ ID NO:2420), KFFVVEEYTD (SEQ ID NO:2421), KFFVVEEYTGD (SEQ ID NO:2422), KDELD (SEQ ID NO:2423), KDELTD (SEQ ID NO:2424), KDELTGD (SEQ ID NO:2425), KIDELD (SEQ ID NO:2426), KIDELTD (SEQ ID NO:2427), KIDELTGD (SEQ ID NO:2428), KLIDELD (SEQ ID NO:2429), KLIDELTD (SEQ ID NO:2430), KLIDELTGD (SEQ ID NO:2431), KFLIDELD (SEQ ID NO:2432), KFLIDELTD (SEQ ID NO:2433), KFLIDELTGD (SEQ ID NO:2434), KIFLIDELD (SEQ ID NO:2435), KIFLIDELTD (SEQ ID NO:2436), KIFLIDELTGD (SEQ ID NO:2437), KDPKD (SEQ ID NO:2438), KDPKTD (SEQ ID NO:2439), KDPKTGD (SEQ ID NO:2440), KVDPKD (SEQ ID NO:2441), KVDPKTD (SEQ ID NO:2442), KVDPKTGD (SEQ ID NO:2443), KTVDPKD (SEQ ID NO:2444), KTVDPKTD (SEQ ID NO:2445), KTVDPKTGD (SEQ ID NO:2446), KFTVDPKD (SEQ ID NO:2447), KFTVDPKTD (SEQ ID NO:2448), KFTVDPKTGD (SEQ ID NO:2449), KHFTVDPKD (SEQ ID NO:2450), KHFTVDPKTD (SEQ ID NO:2451), KHFTVDPKTGD (SEQ ID NO:2452), KDADD (SEQ ID NO:2453), KDADTD (SEQ ID NO:2454), KDADTGD (SEQ ID NO:2455), KIDADD (SEQ ID NO:2456), KIDADTD (SEQ ID NO:2457), KIDADTGD (SEQ ID NO:2458), KDIDADD (SEQ ID NO:2459), KDIDADTD (SEQ ID NO:2460), KDIDADTGD (SEQ ID NO:2461), KFDIDADD (SEQ ID NO:2462), KFDIDADTD (SEQ ID NO:2463), KFDIDADTGD (SEQ ID NO:2464), KIFDIDADD (SEQ ID NO:2465), KIFDIDADTD (SEQ ID NO:2466), KIFDIDADTGD (SEQ ID NO:2467), DEEYK (SEQ ID NO::2468), DEEYTK (SEQ ID NO:2469), DEEYTGK (SEQ ID NO:2470), DVEEYK (SEQ ID NO:2471), DVEEYTK (SEQ ID NO:2472), DVEEYTGK (SEQ ID NO:2473), DVVEEYK (SEQ ID NO:2474), DVVEEYTK (SEQ ID NO:2475), DVVEEYTGK (SEQ ID NO:2476), DFVVEEYK (SEQ ID NO:2477), DFVEEYTK (SEQ ID NO:2478), DFVVEEYTK (SEQ ID NO:2479), DFFVVEEYK (SEQ ID NO:2480), DFFVVEEYTK, (SEQ ID NO:2481), DFFVVEEYTGK (SEQ ID NO:2482), DDELK (SEQ ID NO:2483), DDELTK (SEQ ID NO:2484), DDELTGK (SEQ ID NO:2485), DIDELK (SEQ ID NO:2486), DIDELTK (SEQ ID NO:2487), DIDELTGK (SEQ ID NO:2488), DLIDELK (SEQ ID NO:2489), DLIDELTK (SEQ ID NO:2490), DLIDELTGK (SEQ ID NO:2491), DFLIDELK (SEQ ID NO:2492), DFLIDELTK (SEQ ID NO:2493), DFLIDELTGK (SEQ ID NO:2494), DIFLIDELK (SEQ ID NO:2495), DIFLIDELTK (SEQ ID NO:2496), DIFLIDELTGK (SEQ ID NO:2497), DDPKK (SEQ ID NO:2498), DDPKTK (SEQ ID NO:2499), DDPKTGK (SEQ ID NO:2500), DVDPKK (SEQ ID NO:2501), DVDPKYK (SEQ ID NO:2502), DVTPKTGK (SEQ ID NO:2503), DTVDPKK (SEQ ID NO:2504), DTVDPKTK (SEQ ID NO:2505), DTVDPKTGK (SEQ ID NO:2506), DFTVDPKK (SEQ ID NO:2507), DFTVDPKTK (SEQ ID NO:2508), DFTVDPKTGK (SEQ ID NO:2509), DHFTVDPKK (SEQ ID NO:2510), DHFTVDPKTK (SEQ ID NO:2511), DHFTVDPKTGK (SEQ ID NO:2512), DDADK (SEQ ID NO:2513), DDADTK (SEQ ID NO:2514), DDADTGK (SEQ ID NO:2515), DIDADK (SEQ ID NO:2516), DIDADTK (SEQ ID NO:2517), DIDADTGK (SEQ ID NO:2518), DDIDADK (SEQ ID NO:2519), DDIDADTK (SEQ ID NO:2520), DDIDADTGK (SEQ ID NO:2521), DFDIDADK (SEQ ID NO:2522), DFDIDADTK (SEQ ID NO:2523), DFDIDADTGK (SEQ ID NO:2524), DIFDIDADK (SEQ ID NO:2525), DIFDIDADTK (SEQ ID NO:2526), DIFDIDADTGK (SEQ ID NO:2527), KEEYE (SEQ ID NO:2528), KEEYTE (SEQ ID NO:2529), KEEYTGE (SEQ ID NO:2530), KVEEYE (SEQ ID NO:2531), KVEEYTE (SEQ ID NO:2532), KVEEYTGE (SEQ ID NO:2533), KVVEEYE (SEQ ID NO:2534), KVVEEYTE (SEQ ID NO:2535), KVVEEYTGE (SEQ ID NO:2536), KFVVEEYE (SEQ ID NO:2537), KFVEEYTE (SEQ ID NO:2538), KFVEEYTGE (SEQ ID NO:2539), KFFVVEEYE (SEQ ID NO:2540), KFFVVEEYTE (SEQ ID NO:2541), KFFVVEEYTGE (SEQ ID NO:2542), KDELE (SEQ ID NO:2543), KDELTE (SEQ ID NO:2544), KDELTGE (SEQ ID NO:2545), KIDELE (SEQ ID NO:2546), KIDELTE (SEQ ID NO:2547), KIDELTGE (SEQ ID NO:2548), KLIDELE (SEQ ID NO:2549), KLIDELTE (SEQ ID NO:2550), KLIDELTGE (SEQ ID NO:2551), KFLIDELE (SEQ ID NO:2552), KFLIDELTE (SEQ ID NO:2553), KFLIDELTGE (SEQ ID NO:2554), KIFLIDELE (SEQ ID NO:2555), KIFLIDELTE (SEQ ID NO:2556), KIFLIDELTGE (SEQ ID NO:2557), KDPKE (SEQ ID NO:2558), KDPKTE (SEQ ID NO:2559), KDPKTGE (SEQ ID NO:2560), KVDPKE (SEQ ID NO:2561), KVDPKTE (SEQ ID NO:2562), KDPKTGE (SEQ ID NO:2563), KTVDPKE (SEQ ID NO:2564), KTVDPKTE (SEQ ID NO:2565), KTVDPKTGE (SEQ ID NO:2566), KFTVDPKE (SEQ ID NO:2567), KFTVDPKTE (SEQ ID NO:2568), KFTVDPKTGE (SEQ ID NO:2569), KHFTVDPKE (SEQ ID NO:2570), KHFTVDPKTE (SEQ ID NO:2571), KHFTVDPKTGE (SEQ ID NO:2572), KDADE (SEQ ID NO:2573), KDADTE (SEQ ID NO:2574), KDADTGE (SEQ ID NO:2575), KIDADE (SEQ ID NO:2576), KIDADTE (SEQ ID NO:2577), KIDADTGE (SEQ ID NO:2578), KDIDADE (SEQ ID NO:2579), KDIDADTE (SEQ ID NO:2580), KDIDADTGE (SEQ ID NO:2581), KFDIDADE (SEQ ID NO:2582), KFDIDADTE (SEQ ID NO:2583), KFDIDADTGE (SEQ ID NO:2584), KIFDIDADE (SEQ ID NO:2585), KIFDIDADTE (SEQ ID NO:2586), KIFDIDADTGE (SEQ ID NO:2587), VEEYT (SEQ ID NO:2588), VEEYTG (SEQ ID NO:2589), VVEEY (SEQ ID NO:2590), VVEEYT (SEQ ID NO:2591), VVEEYTG (SEQ ID NO:2592), FVVEEY (SEQ ID NO:2593), FVEEYT (SEQ ID NO:2594), FVEEYTG (SEQ ID NO:2595), FFVVEEY (SEQ ID NO:2596), FFVVEEYT (SEQ ID NO:2597), FFVVEEYTG (SEQ ID NO:2598), LIDEL (SEQ ID NO:2599), LIDELT (SEQ ID NO:2600), LIDELTG (SEQ ID NO:2601), FLIDEL (SEQ ID NO:2602), FLIDELT (SEQ ID NO:2603), FLIDELTG (SEQ ID NO:2604), IFLIDEL (SEQ ID NO:2605), IFLIDELT (SEQ ID NO:2606), IFLIDELTG (SEQ ID NO:2607), TVDPK (SEQ ID NO:2608), TVDPKT (SEQ ID NO:2609), TVDPKTG (SEQ ID NO:2610), FTVDPK (SEQ ID NO:2611), FTVDPKT (SEQ ID NO:2612), FTVDPKTG (SEQ ID NO:2613), HFTVDPK (SEQ ID NO:2614), HFTVDPKT (SEQ ID NO:2615), HFTVDPKTG (SEQ ID NO:2616), DADTG (SEQ ID NO:2617), IDADT (SEQ ID NO:2618), IDADTG (SEQ ID NO:2619), DIDAD (SEQ ID NO:2620), DIDADT (SEQ ID NO:2621), DIDADTG (SEQ ID NO:2622), FDIDAD (SEQ ID NO:2623), FDIDADT (SEQ ID NO:2624), FDIDADTG (SEQ ID NO:2625), IFDIDAD (SEQ ID NO:2626), IFDIDADT (SEQ ID NO:2627) and IFDIDADTG (SEQ ID NO:2628).

Representative cyclic peptides comprising a LI-cadherin CAR sequence include: CNNKC (SEQ ID NO:2629), CNNKTC (SEQ ID NO:2630), CNNKTGC (SEQ ID NO:2631), CINNKC (SEQ ID NO:2632), CINNKTC (SEQ ID NO:2633), CINNKTGC (SEQ ID NO:263 4), CQINNKC (SEQ ID NO:2635), CQINNKTC (SEQ ID NO:2636), CQINNKTGC (SEQ ID NO:2637), CFQINNKC (SEQ ID NO:2638), CFQINNKTC (SEQ ID NO:2639), CFQINNKTGC (SEQ ID NO:2640), CYFQINNKC (SEQ ID NO:2641), CYFQINNKTC (SEQ ID NO:2642), CYFQINNKTGC (SEQ ID NO:2643), ENNKK (SEQ ID NO:2644), ENNKTK (SEQ ID NO:2645), ENNKTGK (SEQ ID NO:2646), EINNKK (SEQ ID NO:2647), EINNKTK (SEQ ID NO:2648), EINNKTGK (SEQ ID NO:2649), EQINNKK (SEQ ID NO:2650), EQINNKTK (SEQ ID NO:2651), EQINNKTGK (SEQ ID NO:2652), EFQINNKK (SEQ ID NO:2653), EFQINNKTK (SEQ ID NO:2654), EFQINNKTGK (SEQ ID NO:2655), EYFQINNKK (SEQ ID NO:2656), EYFQINNKTK (SEQ ID NO:2657), EYFQNNKTGK (SEQ ID NO:2658), KNNKD (SEQ ID NO:2659), KNNKTD (SEQ ID NO:2660), KNNKTGD (SEQ ID NO:2661), KINNKD (SEQ ID NO:2662), KINNKTD (SEQ ID NO:2663), KINNKTGD (SEQ ID NO:2664), KQINNKD (SEQ ID NO:2665), KQINNKTD (SEQ ID NO:2666), KQINNKTGD (SEQ ID NO:2667), KFQINNKD (SEQ ID NO:2668), KFQINNKTD (SEQ ID NO:2669), KFQINNKTGD (SEQ ID NO:2670), KYFQINNKD (SEQ ID NO:2671), KYFQINNKTD (SEQ ID NO:2672), KYFQINNKTGD (SEQ ID NO:2673), DNNKK (SEQ ID NO:2674), DNNKTK (SEQ ID NO:2675), DNNKTGK (SEQ ID NO:2676), DINNKK (SEQ ID NO:2677), DINNKTK (SEQ ID NO:2678), DINNKTGK (SEQ ID NO:2679), DQINNKK (SEQ ID NO:2680), DQINNKTK (SEQ ID NO:2681), DQINNKTGK (SEQ ID NO:2682), DFQINNKK (SEQ ID NO:2683), DFQINNKTK (SEQ ID NO:2684), DFQINNKTGK (SEQ ID NO:2685), DYFQINNKK (SEQ ID NO:2686), DYFQINNKTK (SEQ ID NO:2687), DYFQINNKTGK (SEQ ID NO:2688), KNNKE (SEQ ID NO:2689), KNNKTE (SEQ ID NO:2690), KNNKTGE (SEQ ID NO:2691), KINNKE (SEQ ID NO:2692), KINNKTE (SEQ ID NO:2693), KINNKTGE (SEQ ID NO:2694), KQINNKE (SEQ ID NO:2695), KQINNKTE (SEQ ID NO:2696), KQINNKTGE (SEQ ID NO:2697), KFQINNKE (SEQ ID NO:2698), KFQINNKTE (SEQ ID NO:2699), KFQINNKTGE (SEQ ID NO:2700), KYFQINNKE (SEQ ID NO:2701), KYFQINNKTE (SEQ ID NO:2702), KYFQINNKTGE (SEQ ID NO:2703), NNKTG (SEQ ID NO:2704), INNKT (SEQ ID NO:2705), INNKTG (SEQ ID NO:2706), QINNK (SEQ ID NO:2707), QINNKT (SEQ ID NO:2708), QINNKTG (SEQ ID NO:2709), FQINNK (SEQ ID NO:2710), FQNNKT (SEQ ID NO:2711), FQINNKTG (SEQ ID NO:2712), YFQINNK (SEQ ID NO:2713), YFQINNKT (SEQ ID NO:2714) and YFQINNKTG (SEQ ID NO:2715).

Representative cyclic peptides comprising a protocadherin CAR sequence include: CDLVC (SEQ ID NO:2716), CDLVTC (SEQ ID NO:2717), CDLVTGC (SEQ ID NO:2718), CLDLVC (SEQ ID NO:2719), CLDLVTC (SEQ ID NO:2720), CLDLVTGC (SEQ ID NO:2721), CALDLVC (SEQ ID NO:2722), CALDLVTC (SEQ ID NO:2723), CALDLVTGC (SEQ ID NO:2724), CFALDLVC (SEQ ID NO:2725), CFALDLVTC (SEQ ID NO:2726), CFALDLVTGC (SEQ ID NO:2727), CLFALDLVC (SEQ ID NO:2728), CLFALDLVTC (SEQ ID NO:2729), CLFALDLVTGC (SEQ ID NO:2730), CNRDC (SEQ ID NO:2731), CNRDNC (SEQ ID NO:2732), CNRDNGC (SEQ ID NO:2733), CINRDC (SEQ ID NO:2734), CINRDNC (SEQ ID NO:2735), CINRDNGC (SEQ ID NO:2736), CTINRDC (SEQ ID NO:2737), CTINRDNC (SEQ ID NO:2738), CTINRDNGC (SEQ ID NO:2739), CFTINRDC (SEQ ID NO:2740), CFTINRDNC (SEQ ID NO:2741), CFTINRDNGC (SEQ ID NO:2742), CYFTINRDC (SEQ ID NO:2743), CYFTINRDNC (SEQ ID NO:2744), CYFTINRDNGC (SEQ ID NO:2745), CDPSC (SEQ ID NO:2746), CDPSSC (SEQ ID NO:2747), CDPSSGC (SEQ ID NO:2748), CIDPSC (SEQ ID NO:2749), CIDPSSC (SEQ ID NO:2750), CIDPSSGC (SEQ ID NO:2751), CEIDPSC (SEQ ID NO:2752), CEIDPSSC (SEQ ID NO:2753), CEIDPSSGC (SEQ ID NO:2754), CFEIDPSC (SEQ ID NO:2755), CFEIDPSSC (SEQ ID NO:2756), CEIDPSSGC (SEQ ID NO:2757), CFEIDPSC (SEQ ID NO:2758), CFEIDPSSC (SEQ ID NO:2759), CFEIDPSSGC (SEQ ID NO:2760), CLFEIDPSC (SEQ ID NO:2761), CLFEIDPSSC (SEQ ID NO:2762), CLFEIDPSSGC (SEQ ID NO:2763), EDLVK (SEQ ID NO:2764), EDLVTK (SEQ ID NO:2765), EDLVTGK (SEQ ID NO:2766), ELDLVK (SEQ ID NO:2767), ELDLVTK (SEQ ID NO:2768), ELDLVTGK (SEQ ID NO:2769), EALDLVK (SEQ ID NO:2770), EALDLVTK (SEQ ID NO:2771), EALDLVTGK (SEQ ID NO:2772), EFALDLVK (SEQ ID NO:2773), EFALDLVTK (SEQ ID NO:2774), EFALDLVTGK (SEQ ID NO:2775), ELFALDLVK (SEQ ID NO:2776), ELFALDLVTK (SEQ ID NO: 2777), ELFALDLVTGK (SEQ ID NO:2778), ENRDK (SEQ ID NO:2779), ENRDNK (SEQ ID NO:2780), ENRDNGK (SEQ ID NO:2781), EINRDK (SEQ ID NO:2782), EINRDNK (SEQ ID NO: 2783), EINRDNGK (SEQ ID NO:2784), ETINRDK (SEQ ID NO:2785), ETINRDNK (SEQ ID NO:2786), ETINRDNGK (SEQ ID NO:2787), EFTINRDK (SEQ ID NO:2788), EFTINRDNK (SEQ ID NO:2789), EFTINRDNGK (SEQ ID NO:2790), EYFTINRDK (SEQ ID NO:2791), EYFTINRDNK (SEQ ID NO:2792), EYFTINRDNGK (SEQ ID NO:2793), EDPKK (SEQ ID NO:2794), EDPKTK (SEQ ID NO:2795), EDPKTGK (SEQ ID NO:2796), EIDPKK (SEQ ID NO:2797), EIDPKTK (SEQ ID NO:2798), EIDPKTGK (SEQ ID NO:2799), ESIDPKK (SEQ ID NO:2800), ESIDPKTK (SEQ ID NO:2801), ESIDPKTGK (SEQ ID NO:2802), EFSIDPKK (SEQ ID NO:2803), EFSIDPKTK (SEQ ID NO:2804), EFSIDPKTGK (SEQ ID NO:2805), ELFSIDPKK (SEQ ID NO:2806), ELFSIDPKTK (SEQ ID NO:2807), ELFSIDPKTGK (SEQ ID NO:2808), EDPSK (SEQ ID NO:2809), EDPSSK (SEQ ID NO:2810), EDPSSGK (SEQ ID NO:2811), EIDPSK (SEQ ID NO:2812), EIDPSSK (SEQ ID NO:2813), EIDPSSGK (SEQ ID NO:2814), EEIDPSK (SEQ ID NO:2815), EEIDPSSK (SEQ ID NO:2816), EEIDPSSGK (SEQ ID NO:2817), EFEIDPSK (SEQ ID NO:2818), EFEIDPSSK (SEQ ID NO:2819), EEIDPSSGK (SEQ ID NO:2820), EFEIDPSK (SEQ ID NO:2821), EFEIDPSSK (SEQ ID NO:2822), EFEIDPSSGK (SEQ ID NO:2823), ELFEIDPSK (SEQ ID NO:2824), ELFEIDPSSK (SEQ ID NO:2825), ELFEIDPSSGK (SEQ ID NO:2826), KDLVD (SEQ ID NO:2827), KDLVTD (SEQ ID NO:2828), KDLVTGD (SEQ ID NO:2829), KLDLVD (SEQ ID NO:2830), KLDLVTD (SEQ ID NO:2831), KLDLVTGD (SEQ ID NO:2832), KALDLVD (SEQ ID NO:2833), KALDLVTD (SEQ ID NO:2834), KALDLVTGD (SEQ ID NO:2835), KFALDLVD (SEQ ID NO:2836), KFALDLVTD (SEQ ID NO:2837), KFALDLVTGD (SEQ ID NO:2838), KLFALDLVD (SEQ ID NO:2839), KLFALDLVTD (SEQ ID NO:2840), KLFALDLVTGD (SEQ ID NO:2841), KNRDD (SEQ ID NO:2842), KNRDND (SEQ ID NO:2843), KNRDNGD (SEQ ID NO:2844), KINRDD (SEQ ID NO:2845), KINRDND (SEQ ID NO:2846), KINRDNGD (SEQ ID NO:2847), KTINRDD (SEQ ID NO:2848), KTINRDND (SEQ ID NO:2849), KTINRDNGD (SEQ ID NO:2850), KFTINRDD (SEQ ID NO:2851), KFTINRDND (SEQ ID NO:2852), KFTINRDNGD (SEQ ID NO:2853), KYFTINRDD (SEQ ID NO:2854), KYFTINRDND (SEQ ID NO:2855), KYFTINRDNGD (SEQ ID NO:2856), KDPKD (SEQ ID NO:2857), KDPKTD (SEQ ID NO:2858), KDPKTGD (SEQ ID NO:2859), KIDPKD (SEQ ID NO:2860), KIDPKTD (SEQ ID NO:2861), KIDPKTGD (SEQ ID NO:2862), KSIDPKD (SEQ ID NO:2863), KSIDPKTD (SEQ ID NO:2864), KSIDPKTGD (SEQ ID NO:2865), KFSIDPKD (SEQ ID NO:2866), KFSIDPKTD (SEQ ID NO:2867), KFSIDPKTGD (SEQ ID NO:2868), KLFSIDPKD (SEQ ID NO:2869), KLFSIDPKTD (SEQ ID NO:2870), KLFSIDPKTGD (SEQ ID NO:2871), KDPSD (SEQ ID NO:2872), KDPSSD (SEQ ID NO:2873), KDPSSGD (SEQ ID NO:2874), KIDPSD (SEQ ID NO:2875), KIDPSSD (SEQ ID NO:2876), KIDPSSGD (SEQ ID NO:2877), KEIDPSD (SEQ ID NO:2878), KEIDPSSD (SEQ ID NO:2879), KEIDPSSGD (SEQ ID NO:2880), KFEIDPSD (SEQ ID NO:2881), KFEIDPSSD (SEQ ID NO:2882), KFEIDPSSGD (SEQ ID NO:2886), KLFEIDPSD (SEQ ID NO:2887), KLFEIDPSSD (SEQ ID NO:2888), KLFEIDPSSGD (SEQ ID NO:2889), KDLVE (SEQ ID NO:2890), KDLVTE (SEQ ID NO:2891), KDLVTGE (SEQ ID NO:2892), KLDLVE (SEQ ID NO:2893), KLDLVTE (SEQ ID NO:2894), KLDLVTGE (SEQ ID NO:2895), KALDLVE (SEQ ID NO:2896), KALDLVTE (SEQ ID NO:2897), KALDLVTGE (SEQ ID NO:2898), KFALDLVE (SEQ ID NO:2899), KFALDLVTE (SEQ ID NO:2900), KFALDLVTGE (SEQ ID NO:2901), KLFALDLVE (SEQ ID NO:2902), KLFALDLVTE (SEQ ID NO:2903), KLFALDLVTGE (SEQ ID NO:2904), KNRDE (SEQ ID NO:2905), KNRDNE (SEQ ID NO:2906), KNRDNGE (SEQ ID NO:2907), KINRDE (SEQ ID NO:2908), KINRDNE (SEQ ID NO:2909), KINRDNGE (SEQ ID NO:2910), KTINRDE (SEQ ID NO:2911), KTINRDNE (SEQ ID NO:2912), KTINRDNGE (SEQ ID NO:2913), KFTINRDE (SEQ ID NO:2914), KFTINRDNE (SEQ ID NO:2915), KFTINRDNGE (SEQ ID NO:2916), KYFTINRDE (SEQ ID NO:2917), KYFTINRDNE (SEQ ID NO:2918), KYFTINRDNGE (SEQ ID NO:2919), KDPKE (SEQ ID NO:2920), KDPKTE (SEQ ID NO:2921), KDPKTGE (SEQ ID NO:2922), KIDPKE (SEQ ID NO:2923), KIDPKTE (SEQ ID NO:2924), KIDPKTGE (SEQ ID NO:2925), KSIDPKE (SEQ ID NO:292 6), KSIDPKTE (SEQ ID NO:2927), KSIDPKTGE (SEQ ID NO:2928), KFSIDPKE (SEQ ID NO:2929), KFSIDPKTE (SEQ ID NO:2930), KFSIDPKTGE (SEQ ID NO:2931), KLFSIDPKE (SEQ ID NO:2932), KLFSIDPKTE (SEQ ID NO:2933), KLFSIDPKTGE (SEQ ID NO:2934), KDPSE (SEQ ID NO:2935), KDPSSE (SEQ ID NO:2936), KDPSSGE (SEQ ID NO:2937), KIDPSE (SEQ ID NO:2938), KIDPSSE (SEQ ID NO:2939), KIDPSSGE (SEQ ID NO:2940), KEIDPSE (SEQ ID NO:2941), KEIDPSSE (SEQ ID NO:2942), KEIDPSSGE (SEQ ID NO:2943), KFEIDPSE (SEQ ID NO:2944), KFEIDPSSE (SEQ ID NO:2945), KFEIDPSSGE (SEQ ID NO:2949), KLFEIDPSE (SEQ ID NO:2950), KLFEIDPSSE (SEQ ID NO:2951), KLFEIDPSSGE (SEQ ID NO:2952), DDLVK (SEQ ID NO:2953), DDLVTK (SEQ ID NO:2954), DDLVTGK (SEQ ID NO:2955), DLDLVK (SEQ ID NO:2956), DLDLVTK (SEQ ID NO:2957), DLDLVTGK (SEQ ID NO:2958), DALDLVK (SEQ ID NO:2959), DALDLVTK (SEQ ID NO:2960), DALDLVTGK (SEQ ID NO:2961), DFALDLVK (SEQ ID NO:2962), DFALDLVTK (SEQ ID NO:2963), DFALDLVTGK (SEQ ID NO:2964), DLFALDLVK (SEQ ID NO:2965), DLFALDLVTK (SEQ ID NO:2966), DLFALDLVTGK (SEQ ID NO:2967), DNRDK (SEQ ID NO:2968), DNRDNK (SEQ ID NO:2969), DNRDNGK (SEQ ID NO:2970), DINRDK (SEQ ID NO:2971), DINRDNK (SEQ ID NO:2972), DINRDNGK (SEQ ID NO:2973), DTINRDK (SEQ ID NO:2974), DTINRDNK (SEQ ID NO:2975), DTINRDNGK (SEQ ID NO:2976), DFTINRDK (SEQ ID NO:2977), DFTINRDNK (SEQ ID NO:2978), DFTINRDNGK (SEQ ID NO:2979), DYFTINRDK (SEQ ID NO:2980), DYFTINRDNK (SEQ ID NO:2981), DYFTINRDNGK (SEQ ID NO:2982), DDPKK (SEQ ID NO:2983), DDPKTK (SEQ ID NO:2984), DDPKTGK (SEQ ID NO:2985), DIDPKK (SEQ ID NO:2986), DIDPKTK (SEQ ID NO:2987), DIDPKTGD (SEQ ID NO:2988), DSIDPKK (SEQ ID NO:2989), DSIDPKTK (SEQ ID NO:2990), DSIDPKTGK (SEQ ID NO:2991), DFSIDPKK (SEQ ID NO:2992), DFSIDPKTK (SEQ ID NO:2993), DFSIDPKTGK (SEQ ID NO:2994), DLFSIDPKK (SEQ ID NO:2995), DLFSIDPKTK (SEQ ID NO:2996), DLFSIDPKTGK (SEQ ID NO:2997), DDPSK (SEQ ID NO:2998), DDPSSK (SEQ ID NO:2999), DDPSSGK (SEQ ID NO:3000), DIDPSK (SEQ ID NO:3001), DIDPSSK (SEQ ID NO:3002), DIDPSSGK (SEQ ID NO:3003), DEIDPSK (SEQ ID NO:3004), DEIDPSSK (SEQ ID NO:3005), DEIDPSSGK (SEQ ID NO:3006), DFEIDPSK (SEQ ID NO:3007), DFEIDPSSK (SEQ ID NO:3008), DFEIDPSSGK (SEQ ID NO:3012), DLFEIDPSK (SEQ ID NO:3013), DLFEIDPSSK (SEQ ID NO:3014), DLFEIDPSSGK (SEQ ID NO:3015), DLVTG (SEQ ID NO:3016), LDLVT (SEQ ID NO:3017), LDLVTG (SEQ ID NO:3018), ALDLV (SEQ ID NO:3019), ALDLVT (SEQ ID NO:3020), ALDLVTG (SEQ ID NO:3021), FALDLV (SEQ ID NO:3022), FALDLVTC (SEQ ID NO:3023), FALDLVTG (SEQ ID NO:3024), LFALDLV (SEQ ID NO:3025), LFALDLVI (SEQ ID NO:3026), LFALDLVTG (SEQ ID NO:3027), NRDNG (SEQ ID NO:3028), INRDN (SEQ ID NO:3029), INRDNG (SEQ ID NO:3030), TINRD (SEQ ID NO:3031), TINRDN (SEQ ID NO:3032), TINRDNG (SEQ ID NO:3033), FTINRD (SEQ ID NO:3034), FTINRDN (SEQ ID NO:3035), FTINRDNG (SEQ ID NO:3036), YFTINRD (SEQ ID NO:3037), YFTINRDN (SEQ ID NO:3038), YFTINRDNG (SEQ ID NO:3039), DPKTG (SEQ ID NO:3040), IDPKT (SEQ ID NO:3041), IDPKTG (SEQ ID NO:3042), SIDPK (SEQ ID NO:3043), SIDPKT (SEQ ID NO:3044), SIDPKTG (SEQ ID NO:3045), FSIDPK (SEQ ID NO:3046), FSIDPKT (SEQ ID NO:3047), FSIDPKTG (SEQ ID NO:3048), LFSIDPK (SEQ ID NO:3049), LFSIDPKT (SEQ ID NO:3050), LFSIDPKTG (SEQ ID NO:3051), DPSSG (SEQ ID NO:3052), IDPSS (SEQ ID NO:3053), IDPSSG (SEQ ID NO:3054), EIDPSS (SEQ ID NO:3056), EIDPSSG (SEQ ID NO:3057), FEIDPSS (SEQ ID NO:3058), FEIDPSS (SEQ ID NO:3059), EIDPSSG (SEQ ID NO:3060), FEIDPS (SEQ ID NO:3061), FEIDPSSG (SEQ ID NO:3062), LFEIDPS (SEQ ID NO:3063), LFEIDPSS (SEQ ID NO:3064) and LFEIDPSSG (SEQ ID NO:3065).

Representative cyclic peptides comprising a desmoglein CAR sequence include: CNQKC (SEQ ID NO:3066), CNQKTC (SEQ ID NO:3067), CNQKTGC (SEQ ID NO:3068), CINQKC (SEQ ID NO:3069), CINQKTC (SEQ ID NO:3070), CINQKTGC (SEQ ID NO:3071), CVINQKC (SEQ ID NO:3072), CVINQKTC (SEQ ID NO:3073), CVINQKTGC (SEQ ID NO:3074), CFVINQKC (SEQ ID NO:3075), CFVINQKTC (SEQ ID NO:3076), CFVINQKTGC (SEQ ID NO:3077), CIFVINQKC (SEQ ID NO:3078), CIFVINQKTC (SEQ ID NO:3079), CIFVINQKTGC (SEQ ID NO:3080), CNRNC (SEQ ID NO:3081), CNRNTC (SEQ ID NO:3082), CNRNTGC (SEQ ID NO:3083), CINRNC (SEQ ID NO:3084), CINRNTC (SEQ ID NO:3085), CINRNTGC (SEQ ID NO:3086), CIINRNC (SEQ ID NO:3087), CIINRNTC (SEQ ID NO:3088), CIINRNTGC (SEQ ID NO:3089), CFIINRNC (SEQ ID NO:3090), CFIINRNTC (SEQ ID NO:3091), CFIINRNTGC (SEQ ID NO:3092), CMFIINRNC (SEQ ID NO:3093), CMFIINRNTC (SEQ ID NO:3094), CMFIINRNTGC (SEQ ID NO:3095), CNKDC (SEQ ID NO:3096), CNKDTC (SEQ ID NO:3097), CNKDTGC (SEQ ID NO:3098), CLNKDC (SEQ ID NO:3099), CLNKDTC (SEQ ID NO:3100), CLNKDTGC (SEQ ID NO:3101), CYLNKDC (SEQ ID NO:3102), CYLNKDTC (SEQ ID NO:3103), CYLNKDTGC (SEQ ID NO:3104), CFYLNKDC (SEQ ID NO:3105), CFYLNKDTC (SEQ ID NO:3106), CFYLNKDTGC (SEQ ID NO:3107), CVFYLNKDC (SEQ ID NO:3108), CVFYLNKDTC (SEQ ID NO:3109), CVFYLNKDTGC (SEQ ID NO:3110), ENQKK (SEQ ID NO:3111), ENQKTK (SEQ ID NO:3112), ENQKTGK (SEQ ID NO:3113), EINQKK (SEQ ID NO:3114), EINQKTK (SEQ ID NO:3115), EINQKTGK (SEQ ID NO:3116), EVINQKK (SEQ ID NO:3117), EVINQKTK (SEQ ID NO:3118), EVINQKTGK (SEQ ID NO:3119), EFVINQKK (SEQ ID NO:3120), EFVINQKTK (SEQ ID NO:3121), EFVINQKTGK (SEQ ID NO:3122), EIFVINQKK (SEQ ID NO:3123), EIFVINQKTK (SEQ ID NO:3124), EIFVINQKTGK (SEQ ID NO:3125), ENRNK (SEQ ID NO:3126), ENRNTK (SEQ ID NO:3127), ENRNTGK (SEQ ID NO:3128), EINRNK (SEQ ID NO:3129), EINRNTK (SEQ ID NO:3130), EINRNTGK (SEQ ID NO:3131), EIINRNK (SEQ ID NO:3132), EIINRNTK (SEQ ID NO:3133), EIINRNTGK (SEQ ID NO:3134), EFIINRNK (SEQ ID NO:3135), EFIINRNTK (SEQ ID NO:3136), EFIINRNTGK (SEQ ID NO:3137), EMFIINRNK (SEQ ID NO:3138), EMFIINRNTK (SEQ ID NO:3139), EMFIINRNTGK (SEQ ID NO:3140), ENKDK (SEQ ID NO:3141), ENKDTK (SEQ ID NO:3142), ENKDTGK (SEQ ID NO:3143), ELNKDK (SEQ ID NO:3144), ELNKDTK (SEQ ID NO:3145), ELNKDTGK (SEQ ID NO:3146), EYLNKDK (SEQ ID NO:3147), EYLNKDTK (SEQ ID NO:3148), EYLNKDTGK (SEQ ID NO:3149), EFYLNKDK (SEQ ID NO:3150), EFYLNKDTK (SEQ ID NO:3151), EFYLNKDTGK (SEQ ID NO:3152), EVFYLNKDK (SEQ ID NO:3153), EVFYLNKDTK (SEQ ID NO:3154), EVFYLNKDTGK (SEQ ID NO:3155), KNQKD (SEQ ID NO:3156), KNQKTD (SEQ ID NO:3157), KNQKTGD (SEQ ID NO:3158), KINQKD (SEQ ID NO:3159), KINQKTD (SEQ ID NO:.3160), KINQKTGD (SEQ ID NO:3161), KVINQKD (SEQ ID NO:3162), KVINQKTD (SEQ ID NO:3163), KVINQKTGD (SEQ ID NO:3164), KFVINQKD (SEQ ID NO:3165), KFVINQKTD (SEQ ID NO:3166), KFVINQKTGD (SEQ ID NO:3167), KIFVINQKD (SEQ ID NO:3168), KIFVINQKTD (SEQ ID NO:3169), KIFVINQKTGD (SEQ ID NO:3170), KNRND (SEQ ID NO:3171), KNRNTD (SEQ ID NO:3172), KNRNTGD (SEQ ID NO:3173), KINRND (SEQ ID NO:3174), KINRNTD (SEQ ID NO:3175), KINRNTGD (SEQ ID NO:3176), KIINRND (SEQ ID NO:3177), KIINRNTD (SEQ ID NO:3178), KIINRNTGD (SEQ ID NO:3179), KFIINRND (SEQ ID NO:3180), KFIINRNTD (SEQ ID NO:3181), KFIINRNTGD (SEQ ID NO:3182), KMFIINRND (SEQ ID NO:3183), KMFIINRNTD (SEQ ID NO:3184), KMFIINRNTGD (SEQ ID NO:3185), KNKDD (SEQ ID NO:3186), KNKDTD (SEQ ID NO:3187), KNKDTGD (SEQ ID NO:3188), KLNKDD (SEQ ID NO:3189), KLNKDTD (SEQ ID NO:3190) KLNKDTGD (SEQ ID NO:3191), KYLNKDD (SEQ ID NO:3192), KYLNKCDTD (SEQ ID NO:3193), KYLNKDTGD (SEQ ID NO:3194), KFYLNKDD (SEQ ID NO:3195), KFYLNKDTD (SEQ ID NO:3196), KFYLNKDTGD (SEQ ID NO:3197), KVFYLNKDD (SEQ ID NO:3198), KVFYLNKDTD (SEQ ID NO:3199), KVFYLNKDTGD (SEQ ID NO:3200), DNQKK (SEQ ID NO:3201), DNQKTK (SEQ ID NO:3202), DNQKTGK (SEQ ID NO:3203), DINQKK (SEQ ID NO:3204), DINQKTK (SEQ ID NO:3205), DINQKTGK (SEQ ID NO:3206), DVINQKK (SEQ ID NO:3207), DVINQKTK (SEQ ID NO:3208), DVINQKTGK (SEQ ID NO:3209), DFVINQKK (SEQ ID NO:3210), DFVINQKTK (SEQ ID NO:3211), DFVINQKTGK (SEQ ID NO:3212), DIFVINQKK (SEQ ID NO:3213), DIFVINQKTK (SEQ ID NO:3214), DIFVINQKTGK (SEQ ID NO:3215), DNRNK (SEQ ID NO:3216), DNRNTK (SEQ ID NO:3217), DNRNTGK (SEQ ID NO:3218), DINRNK (SEQ ID NO:3219), DINRNTK (SEQ ID NO:3220), DINRNTGK (SEQ ID NO:3221), DIINRNK (SEQ ID NO:3222), DIINRNTK (SEQ ID NO:3223), DIINRNTGK (SEQ ID NO:3224), DFIINRNK (SEQ ID NO:3225), DFIINRNTK (SEQ ID NO:3226), DFIINRNTGK (SEQ ID NO:3227), DMFIINRNK (SEQ ID NO:3228), DMFIINRNTK (SEQ ID NO:3229), DMFIINRNTGK (SEQ ID NO:3230), DNKDK (SEQ ID NO:3231), DNKDTK (SEQ ID NO:3232), DNKDTGK (SEQ ID NO:3233), DLNKDK (SEQ ID NO:3234), DLNKDTK (SEQ ID NO:3235), DLNKDTGK (SEQ ID NO:3236), DYLNKDK (SEQ ID NO: 3237), DYLNKDTK (SEQ ID NO:3238), DYLNKDTGK (SEQ ID NO:3239), DFYLNKDK (SEQ ID NO:3240), DFYLNKDTK (SEQ ID NO: 3243), DFYLNKDTGK (SEQ ID NO:3242), DVFYLNKDK (SEQ ID NO:3243), DVFYLNKDTK (SEQ ID NO:3244), DVFYLNKDTGK (SEQ ID NO:3245), KKNQKE (SEQ ID NO:3246), KNQKTE (SEQ ID NO:3247), KNQKTGE (SEQ ID NO:3248), KINQKE (SEQ ID NO:3249), KINQKTE (SEQ ID NO:3250), KINQKTGE (SEQ ID NO:3251), KVINQKE (SEQ ID NO:3252), KVINQKTE (SEQ ID NO:3253), KVINQKTGE (SEQ ID NO:3254), KFVINQKE (SEQ ID NO:3255), KFVINQKTE (SEQ ID NO:3256), KFVINQKTGE (SEQ ID NO:3257), KIFVINQKE (SEQ ID NO:3258), KIFVINQKTE (SEQ ID NO:3259), KIFVINQKTGE (SEQ ID NO:3260), KNRNE (SEQ ID NO:3261), KNRNTE (SEQ ID NO:3262), KNRNTGE (SEQ ID NO:3263), KINRNE (SEQ ID NO:3264), KINRNTE (SEQ ID NO:3265), KINRNTGE (SEQ ID NO:3266), KIINRNE (SEQ ID NO:3267), KIINRNTE (SEQ ID NO:3268), KIINRNTGE (SEQ ID NO:3269), KFIINRNE (SEQ ID NO:3270), KFIINRNTE (SEQ ID NO:3271), KFIINRNTGE (SEQ ID NO:3272), KMFIINRNE SEQ ID NO:3273), KMFIINRNTE (SEQ ID NO:3274), KMFIINRNTGE (SEQ ID NO:3275), KNKDE (SEQ ID NO:3276), KNKDTE (SEQ ID NO:3277), KNKDTGE (SEQ ID NO:3278), KLNKDE (SEQ ID NO:3279), KLNKDTE (SEQ ID NO:3280), KLNKDTGE (SEQ ID NO:3281), KYLNKDE (SEQ ID NO:3282), KYLNKDTE (SEQ ID NO:3283), KYLNKDTGE (SEQ ID NO:3284), KFYLNKDE (SEQ ID NO:3285), KFYLNKDTE (SEQ ID NO:3286), KFYLNKDTGE (SEQ ID NO:3287), KVFYLNKDE (SEQ ID NO:3288), KVFYLNKDTE (SEQ ID NO:3289), KVFYLNKDTGE (SEQ ID NO:3290), NQKTG (SEQ ID NO:3291), INQKT (SEQ ID NO:3292), INQKTG (SEQ ID NO:3293), VINQK (SEQ ID NO:3294), VINQKT (SEQ ID NO:3295), VINQKTG (SEQ ID NO:3296), FVINQK (SEQ ID NO:3297), FVINQKT (SEQ ID NO:3298), FVINQKTG (SEQ ID NO:3299), IFVINQK (SEQ ID NO:3300), IFVINQKT (SEQ ID NO:3301), IFVINQKTG (SEQ ID NO:3302), NRNTG (SEQ ID NO:3303), INRNT (SEQ ID NO:3304), INRNTG (SEQ ID NO:3305), IINRN (SEQ ID NO:3306), IINRNT (SEQ ID NO:3307), IINRNTG (SEQ ID NO:3308), FIINRN (SEQ ID NO:3309), FIINRNT (SEQ ID NO:3310), FIINRNTG (SEQ ID NO:3311), MFIINRN (SEQ ID NO: 3312), MFIINRNT (SEQ ID NO:3313), MFIINRNTG (SEQ ID NO:3314), NKDTG (SEQ ID NO:3315), LNKDT (SEQ ID NO:3316), LNKDTG (SEQ ID NO:3317), YLNKD (SEQ ID NO:3318), YLNKDT (SEQ ID NO:3319), YLNKDTG (SEQ ID NO:3320), FYLNKD (SEQ ID NO:3321), FYLNKDT (SEQ ID NO:3322), FYLNKDTG (SEQ ID NO:3323), VFYLNKD (SEQ ID NO:3324), VFYLNKDT (SEQ ID NO:3325) and VFYLNKDTG (SEQ ID NO:3326).

Representative cyclic peptides comprising a desmocollin CAR sequence include: CEKDC (SEQ ID NO:3327), CEKDTC (SEQ ID NO:3328), CEKDTGC (SEQ ID NO:3329), CIEKDC (SEQ ID NO:3330), CIEKDTC (SEQ ID NO:3331), CIEKDTGC (SEQ ID NO:3332), CYIEKDC (SEQ ID NO:3333), CYIEKDTC (SEQ ID NO:3334), CYIEKDTGC (SEQ ID NO:3335), CFYIEKDC (SEQ ID NO:3336), CFYIEKDTC (SEQ ID NO:3337), CFYIEKDTGC (SEQ ID NO:3338), CLFYIEKDC (SEQ ID NO:3339), CLFYIEKDTC (SEQ ID NO:3340), CLFYIEKDTGC (SEQ ID NO:3341), CERDC (SEQ ID NO:3342), CERDTC (SEQ ID NO:3343), CERDTGC SEQ ID NO:3344), CVERDC (SEQ ID NO:3345), CVERDTC (SEQ ID NO:3346), CVERDTGC (SEQ ID NO:3347), CYVERDC (SEQ ID NO:3348), CYVERDTC (SEQ ID NO:3349), CYVERDTGC (SEQ ID NO:3350), CFYVERDC (SEQ ID NO:3351), CFYVERDTC (SEQ ID NO:3352), CFYVERDTGC (SEQ ID NO:3353), CLFYVERDC (SEQ ID NO:3354), CLFYVERDTC (SEQ ID NO:3355), CLFYVERDTGC (SEQ ID NO:3356), CIERDC (SEQ ID NO:3357), CIERDTC (SEQ ID NO:3358), CIERDTGC (SEQ ID NO:3359), CYIERDC (SEQ ID NO:3360), CYIERDTC (SEQ ID NO:3361), CYIERDTGC (SEQ ID NO:3362), CFYIERDC (SEQ ID NO:3363), CFYIERDTC (SEQ ID NO:3364), CFYIERDTGC (SEQ ID NO:3365), CLFYIERDC (SEQ ID NO:3366), CLFYIERDTC (SEQ ID NO:3367), CLFYIERDTGC (SEQ ID NO:3368), EEKDK (SEQ ID NO:3369), EEKDTK (SEQ ID NO:3370), EEKDTGK (SEQ ID NO:3371), EIEKDK (SEQ ID NO:3372), EIEKDTK (SEQ ID NO:3373), EIEKDTGK (SEQ ID NO:3374), EYIEKDK (SEQ ID NO:3375), EYIEKDTK (SEQ ID NO:3376), EYIEKDTGK (SEQ ID NO:3377), EFYIEKDK (SEQ ID NO:3378), EFYIEKDTK (SEQ ID NO:3379), EFYIEKDTGK (SEQ ID NO:3380), ELFYIEKDK (SEQ ID NO:3381), ELFYIEKDTK (SEQ ID NO:3382), ELFYIEKDTGK (SEQ ID NO:3383), EERDK (SEQ ID NO:3384), EERDTK (SEQ ID NO:3385), EERDTGK (SEQ ID NO:3386), EVERDK (SEQ ID NO:3387), EVERDTK (SEQ ID NO:3388), EVERDTGK (SEQ ID NO:3389), EYVERDK (SEQ ID NO:3390), YVERDTK (SEQ ID NO:3391), EYVERDTGK (SEQ ID NO:3392), EFYVERDK (SEQ ID NO:3393), EFYVERDTK (SEQ ID NO:3394), EFYVERDTGK (SEQ ID NO:3395), ELFYVERDK (SEQ ID NO:3396), ELFYVERDTK (SEQ ID NO:3397), ELFYVERDTGK (SEQ ID NO:3398), EIERDK (SEQ ID NO:3399), EIERDTK (SEQ ID NO:3400), EIERDTGK (SEQ ID NO:3401), EYIERDK (SEQ ID NO:3402), EYIERDTK (SEQ ID NO:3403), EYIERDTGK (SEQ ID NO:3404), EFYIERDK (SEQ ID NO:3405), EFYIERDTK (SEQ ID NO:3406), EFYIERDTGK (SEQ ID NO:3407), ELFYIERDK (SEQ ID NO:3408), ELFYIERDTK (SEQ ID NO:3409), ELFYIERDTGK (SEQ ID NO:3410), KEKDD (SEQ ID NO:3411), KEKDTD (SEQ ID NO:3412), KEKDTGD (SEQ ID NO:3413), KIEKDD (SEQ ID NO:3414), KIEKDTD (SEQ ID NO:3415), KIEKDTGD (SEQ ID NO:3416), KYIEKDD (SEQ ID NO:3417), KYIEKDTD (SEQ ID NO:3418), KYIEKDTGD (SEQ ID NO:3419), KFYIEKDD (SEQ ID NO:3420), KFYIEKDTD (SEQ ID NO:3421), KFYIEKDTGD (SEQ ID NO:3422), KLFYIEKDD (SEQ ID NO:3423), KLFYIEKDTD (SEQ ID NO:3424), KLFYIEKDTGD (SEQ ID NO:3425), KERDD (SEQ ID NO:3426), KERDTD (SEQ ID NO:3427), KERDTGD (SEQ ID NO:3428), KVERDD (SEQ ID NO:3429), KVERDTD (SEQ ID NO:3430), KVERDTGD (SEQ ID NO:3431), KYVERDD (SEQ ID NO:3432), KYVERDTD (SEQ ID NO:3433), KYVERDTGD (SEQ ID NO:3434), KFYVERDD (SEQ ID NO:3435), KFYVERDTD (SEQ ID NO:3436), KFYVERDTGD (SEQ ID NO:3437), KLFYVERDD (SEQ ID NO:3438), KLFYVERDTD (SEQ ID NO:3439), KLFYVERDTGD (SEQ ID NO:3440), KIERDD (SEQ ID NO:3441), KIERDTD (SEQ ID NO:3442), KIERDTGD (SEQ ID NO:3443), KYIERD (SEQ ID NO:3444), KYIERDTD (SEQ ID NO:3445), KYIERDTGD (SEQ ID NO:3446), KFYIERDD (SEQ ID NO:3447), KFYIERDTD (SEQ ID NO:3448), KFYIERDTGD (SEQ ID NO:3449), KLFYIERDD (SEQ ID NO:3450), KLFYIERDTD (SEQ ID NO:3451), KLFYIERDTGD (SEQ ID NO:3452), DEKDK (SEQ ID NO:3453), DEKDTK (SEQ ID NO:3454), DEKDTGK (SEQ ID NO:3455), DIEKDK (SEQ ID NO:3456), DIEKDTK (SEQ ID NO:3457), DIEKDTGK (SEQ ID NO:3458), DYIEKDK (SEQ ID NO:3459), DYIEKDTK (SEQ ID NO:3460), DYIEKDTGK (SEQ ID NO:3461), DFYIEKDK (SEQ ID NO:3462), DFYIEKDTK (SEQ ID NO:3463), DFYIEKDTGK (SEQ ID NO:3464), DLFYIEKDK (SEQ ID NO:3465), DLFYIEKDTK (SEQ ID NO:3466), DLFEKDTGK (SEQ ID NO:3467), DERDK (SEQ ID NO:3468), DERDTK (SEQ ID NO:3469), DERDTGK (SEQ ID NO:3470), DVERDK (SEQ ID NO:3471), DVERDTK (SEQ ID NO:3472), DVERDTGK (SEQ ID NO:3473), DYVERDK (SEQ ID NO:3474), DYVERDTK (SEQ ID NO:3475), DYVERDTGK (SEQ ID NO:3476), DFYVERDK (SEQ ID NO:3477), DFYVERDTK (SEQ ID NO:3478), DFYVERDTGK (SEQ ID NO:3479), DLFYVERDK (SEQ ID NO:3480), DLFYVERDTK (SEQ ID NO:3481), DLFYVERDTGK (SEQ ID NO:3482), DIERDK (SEQ ID NO:3483), DIERDTK (SEQ ID NO:3484), DIERDTGK (SEQ ID NO:3485), DYIERDK (SEQ ID NO:3486), DYIERDTK (SEQ ID NO:3487), DYIERDTGK (SEQ ID NO:3488), DFYIERDK (SEQ ID NO:3489), DFYIERDTK (SEQ ID NO:3490), DFYIERDTGK (SEQ ID NO:3491), DLFYIERDK (SEQ ID NO:3492), DLFYIERDTK (SEQ ID NO:3493), DLFYIERDTGK (SEQ ID NO:3494), KEKDE (SEQ ID NO:3495), KEKDTE (SEQ ID NO:3496), KEKDTGE (SEQ ID NO:3497), KIEKDE (SEQ ID NO:3498), KIEKDTE (SEQ ID NO:3499), KIEKDTGE (SEQ ID NO:3500), KYIEKDE (SEQ ID NO:3501), KYIEKDTE (SEQ ID NO:3502), KYIEKDTGE (SEQ ID NO:3503), KFYIEKDE (SEQ ID NO:3504), KFYIEKDTE (SEQ ID NO:3505), KFYIEKDTGE (SEQ ID NO:3506), KLFYIEKDE (SEQ ID NO:3507), KLFYIEKDTE (SEQ ID NO:3508), KLFYIEKDTGE (SEQ ID NO:3509), KERDE (SEQ ID NO:3510), KERDTE (SEQ ID NO:3511), KERDTGE (SEQ ID NO:3512), KVERDE (SEQ ID NO:3513), KVERDTE (SEQ ID NO:3514), KVERDTGE (SEQ ID NO:3515), KYVERDE (SEQ ID NO:3516), KYVERDTE (SEQ ID NO:3517), KYVERDTGE (SEQ ID NO:3518), KFYVERDE (SEQ ID NO:3519), KFYVERDTE (SEQ ID NO:3520), KFYVERDTGE (SEQ ID NO:3521), KLFYVERDE (SEQ ID NO:3522), KLFYVERDTE (SEQ ID NO:3523), KLFYVERDTGE (SEQ ID NO:3524), KIERDE (SEQ ID NO:3525), KIERDTE (SEQ ID NO:3526), KIERDTGE (SEQ ID NO:3527), KYIERDE (SEQ ID NO:3528), KYIERDTE (SEQ ID NO:3529), KYIERDTGE (SEQ ID NO:3530), KFYIERDE (SEQ ID NO:3531), KFYIERDTE (SEQ ID NO:3532), KFYIERDTGE (SEQ ID NO:3533), KLFYIERDE (SEQ ID NO:3534), KLFYIERDTE (SEQ ID NO:3535), KLFYIERDTGE (SEQ ID NO:3536), EKDTG (SEQ ID NO:3537), IEKDT (SEQ ID NO:3538), IEKDTG (SEQ ID NO:3539), YIEKD (SEQ ID NO:3540), YIEKDT (SEQ ID NO:3541), YIEKDTG (SEQ ID NO:3542), FYIEKD (SEQ ID NO:3543), FYIEKDT (SEQ ID NO:3544), FYIEKDTG (SEQ ID NO:3545), LFYIEKD (SEQ ID NO:3546), LFYIEKDT (SEQ ID NO:3547), LFYIEKDTG (SEQ ID NO:3548), ERDTG (SEQ ID NO:3549), VERDT (SEQ ID NO:3550), VERDTG (SEQ ID NO:3551), YVERD (SEQ ID NO:3552), YVERDT (SEQ ID NO:3553), YVERDTG (SEQ ID NO:3554), FYVERD (SEQ ID NO:3555), FYVERDT (SEQ ID NO:3556), FYVERDTG (SEQ ID NO:3557), LFYVERD (SEQ ID NO:3558), LFYVERDT (SEQ ID NO:3559), LFYVERDTG (SEQ ID NO:3560), IERDT (SEQ ID NO:3561), IERDTG (SEQ ID NO:3562), YIERD (SEQ ID NO:3563), YIERDT (SEQ ID NO:3564), YIERDTG (SEQ ID NO:3565), FYIERD (SEQ ID NO:3566), FYIERDT (SEQ ID NO:3567), FYIERDTG (SEQ ID NO:3568), LFYIERD (SEQ ID NO:3569), LFYIERDT (SEQ ID NO:3570) and LFYIERDTG (SEQ ID NO:3571).

Representative cyclic peptides comprising a cnr CAR sequence include: CDPVC (SEQ ID NO:3572), CDPVSC (SEQ ID NO:3573), CDPVSGC (SEQ ID NO:3574), CIDPVC (SEQ ID NO:3575), CIDPVSC (SEQ ID NO:3576), CIDPVSGC (SEQ ID NO:3577), CHIDPVC (SEQ ID NO:3578), CHIDPVSC (SEQ ID NO:3579), CHIDPVSGC (SEQ ID NO:3580), CFHIDPVC (SEQ ID NO:3581), CFHIDPVSC (SEQ ID NO:3582), CFHIDPVSGC (SEQ ID NO:3583), CKFHIDPVC (SEQ ID NO:3584), CKFHIDPVSC (SEQ ID NO:3585), CKFHIDPVSGC (SEQ ID NO:3586), CDADC (SEQ ID NO:3587), CDADTC (SEQ ID NO:3588), CDADTGC (SEQ ID NO:3589), CIDADTC (SEQ ID NO:3590), CIDADC (SEQ ID NO:3591), CIDADTGC (SEQ ID NO:3592), CSIDADC (SEQ ID NO:3593), CSIDADTC (SEQ ID NO:3594), CSIDADTGC (SEQ ID NO:3595), CFSIDADC (SEQ ID NO:3596), CFSIDADTC (SEQ ID NO:3597), CFSIDADTGC (SEQ ID NO:3598), CQFSIDADC (SEQ ID NO:3599), CQFSIDADTC (SEQ ID NO:3600), CQFSIDADTGC (SEQ ID NO:3601), CDSVC (SEQ ID NO:3602), CDSVSC (SEQ ID NO:3603), CDSVSGC (SEQ ID NO:3604), CIDSVC (SEQ ID NO:3605), CIDSVSC (SEQ ID NO:3606), CIDSVSGC (SEQ ID NO:3607), CHIDSVC (SEQ ID NO:3608), CHIDSVSC (SEQ ID NO:3609), CHIDSVSGC (SEQ ID NO:3610), CFHIDSVC (SEQ ID NO:3611), CFHIDSVSC (SEQ ID NO:3612), CFHIDSVSGC (SEQ ID NO:3613), CTFHIDSVC (SEQ ID NO:3614), CTFHIDSVSC (SEQ ID NO:3615), CTFHIDSVSGC (SEQ ID NO:3616), CDSNC (SEQ ID NO:3617), CDSNSC (SEQ ID NO:3618), CDSNSGC (SEQ ID NO:3619), CIDSNC (SEQ ID NO:3620), CIDSNSC (SEQ ID NO:3621), CIDSNSGC (SEQ ID NO:3622), CNIDSNC (SEQ ID NO:3623), CNIDSNSC (SEQ ID NO:3624), CNIDSNSGC (SEQ ID NO:3625), CFNIDSNC (SEQ ID NO:3626), CFNIDSNSC (SEQ ID NO:3627), CFNIDSNSGC (SEQ ID NO:3628), CAFNIDSNC (SEQ ID NO:3629), CAFNIDSNSC (SEQ ID NO:3631), CAFNIDSNSGC (SEQ ID NO:3632), CDSSC (SEQ ID NO:3633), CDSSSC (SEQ ID NO:3634), CDSSSGC (SEQ ID NO:3635), CIDSSC (SEQ ID NO:3636), CIDSSSC (SEQ ID NO:3637), CIDSSSGC (SEQ ID NO:3638), CTIDSSC (SEQ ID NO:3639), CTIDSSSC (SEQ ID NO:3640), CTIDSSSGC (SEQ ID NO:3641), CFTIDSSC (SEQ ID NO:3642), CFTIDSSSC (SEQ ID NO:3643), CFTIDSSSGC (SEQ ID NO:3644), CKFTIDSSC (SEQ ID NO:3645), CKFTIDSSSC (SEQ ID NO:3646), CKFTIDSSSGC (SEQ ID NO:3647), CDEKC (SEQ ID NO:3648), CDEKNC (SEQ ID NO:3649), CDEKNGC (SEQ ID NO:3650), CLDEKC (SEQ ID NO:3651), CLDEKNC (SEQ ID NO:3652), CLDEKNGC (SEQ ID NO:3653), CTLDEKC (SEQ ID NO:3654), CTLDEKNC (SEQ ID NO:3655), CTLDEKNGC (SEQ ID NO:3656), CFTLDEKC (SEQ ID NO:3657), CFTLDEKNC (SEQ ID NO:3658), CFTLDEKNGC (SEQ ID NO:3659), CLFTLDEKC (SEQ ID NO:3660), CLFTLDEKNC (SEQ ID NO:3661), CLFTLDEKNGC (SEQ ID NO:3662), CNEKC (SEQ ID NO:3663), CNEKTC (SEQ ID NO:3664), CNEKTGC (SEQ ID NO:3665), CINEKC (SEQ ID NO:3666), CINEKTC (SEQ ID NO:3667), CINEKTGC (SEQ ID NO:3668), CLINEKC (SEQ ID NO:3669), CLINEKTC (SEQ ID NO:3670), CLINEKTGC (SEQ ID NO:3671), CFLINEKC (SEQ ID NO:3672), CFLINEKTC (SEQ ID NO:3673), CFLINEKTGC (SEQ ID NO:36 74), CKFLINEKC (SEQ ID NO:3675), CKFLINEKTC (SEQ ID NO:3676), CKFLINEKTGC (SEQ ID NO:3677), EDPVK (SEQ ID NO:3678), EDPVSK (SEQ ID NO:3679), EDPVSGK (SEQ ID NO:3680), EIDPVK (SEQ ID NO:3681), EIDPVSK (SEQ ID NO:3682), EIDPVSGK (SEQ ID NO:3683), EHIDPVK (SEQ ID NO:3684), EHIDPVSK (SEQ ID NO:3685), EHIDPVSGK (SEQ ID NO:3686), EFIDPVK (SEQ ID NO:3687), EFHIDPVSK (SEQ ID NO:3688), EFHIDPVSGK (SEQ ID NO:3689), EKFHIDPVK (SEQ ID NO:3690), EKFHIDPVSK (SEQ ID NO:3691), EKFHIDPVSGK (SEQ ID NO:3692), EDADK (SEQ ID NO:3693), EDADTK (SEQ ID NO:3694), EDADTGK (SEQ ID NO:3695), EIDADK (SEQ ID NO:3696), EIDADTK (SEQ ID NO:3697), EIDADTGK (SEQ ID NO:3698), ESIDADK (SEQ ID NO:3699), ESIDADTK (SEQ ID NO:3700), ESIDADTGK (SEQ ID NO:3701), EFSIDADK (SEQ ID NO:3702), EFSIDADTK (SEQ ID NO:3703), EFSIDADTGK (SEQ ID NO:3704), EQFSIDADK (SEQ ID NO:3705), EQFSIDADTK (SEQ ID NO:3706), EQFSIDADTGK (SEQ ID NO:3707), EDSVK (SEQ ID NO:3708), EDSVSK (SEQ ID NO:3709), EDSVSGK (SEQ ID NO:3710), EIDSVK (SEQ ID NO:3711), EIDSVSK (SEQ ID NO:3712), EIDSVSGK (SEQ ID NO:3713), EHIDSVK (SEQ ID NO:3714), EHIDSVSK (SEQ ID NO:3715), EHIDSVSGK (SEQ ID NO:3716), EFHIDSVK (SEQ ID NO:3717), EFHIDSVSK (SEQ ID NO:3718), EFHIDSVSGK (SEQ ID NO:3719), ETFHIDSVK (SEQ ID NO:3720), ETFHIDSVSK (SEQ ID NO:3721), ETFHIDSVSGK (SEQ ID NO:3722), EDSNK (SEQ ID NO:3723), EDSNSK (SEQ ID NO:3724), EDSNSGK (SEQ ID NO:3725), EIDSNK (SEQ ID NO:3726), EIDSNSK (SEQ ID NO:3727), EIDSNSGK (SEQ ID NO:3728), ENIDSNK (SEQ ID NO:3729), ENIDSNSK (SEQ ID NO:3730), ENIDSNSGK (SEQ ID NO:3731), EFNIDSNK (SEQ ID NO:3732), EFNIDSNSK (SEQ ID NO:3733), EFNIDSNSGK (SEQ ID NO:3734), EAFNIDSNK (SEQ ID NO:3735), EAFNIDSNSK (SEQ ID NO:3737), EAFNIDSNSGK (SEQ ID NO:3738), EDSSK (SEQ ID NO:3739), EDSSSK (SEQ ID NO:3740), EDSSSGK (SEQ ID NO:3741), EIDSSK (SEQ ID NO:3742), EIDSSSK (SEQ ID NO:3743), EIDSSSGKS (SEQ ID NO:3744), ETIDSSK (SEQ ID NO:3745), ETIDSSSK (SEQ ID NO:3746), ETIDSSSGK (SEQ ID NO:3747), EFTIDSSK (SEQ ID NO:3748), EFTIDSSSK (SEQ ID NO:3749), EFTIDSSSGK (SEQ ID NO:3750), EKFTIDSSK (SEQ ID NO:3751), EKFTIDSSSK (SEQ ID NO:3752), EKFTIDSSSGK (SEQ ID NO:3753), EDEKK (SEQ ID NO:3754), EDEKNK (SEQ ID NO:3755), EDEKNGK (SEQ ID NO:3756), ELDEKK (SEQ ID NO:3757), ELDEKNK (SEQ ID NO:3758), ELDEKNGK (SEQ ID NO:3759), ETLDEKK (SEQ ID NO:3760), ETLDEKNK (SEQ ID NO:3761), ETLDEKNGK (SEQ ID NO:3762), EFTLDEKK (SEQ ID NO:3763), EFTLDEKNK (SEQ ID NO:3764), EFTLDEKNGK (SEQ ID NO:3765), ELFTLDEKK (SEQ ID NO:3766), ELFTLDEKNK (SEQ ID NO:3767), ELFTLDEKNGK (SEQ ID NO:3768), ENEKK (SEQ ID NO:3769), ENEKTK (SEQ ID NO:3770), ENEKTGK (SEQ ID NO:3771), EINEKK (SEQ ID NO:3772), EINEKTK (SEQ ID NO:3773), EINEKTGK (SEQ ID NO:3774), ELINEKK (SEQ ID NO:3775), ELINEKTK (SEQ ID NO:3776), ELINEKTGK (SEQ ID NO:3777), EFLINEKK (SEQ ID NO:3778), EFLINEKTK (SEQ ID NO:3779), EFLINEKTGK (SEQ ID NO:3780), EKFLINEKK (SEQ ID NO:3781), EKFLINEKTK (SEQ ID NO:3782), EKFLINEKTGK (SEQ ID NO:3783), KDPVD (SEQ ID NO:3784), KDPVSD (SEQ ID NO:3785), KDPVSGD (SEQ ID NO:3786), KIDPVD (SEQ ID NO:3787), KIDPVSD (SEQ ID NO:3788), KIDPVSGD (SEQ ID NO:3789), KHIDPVD (SEQ ID NO:3790), KHIDPVSD (SEQ ID NO:3791), KHIDPVSGD (SEQ ID NO:3792), KFHIDPVD (SEQ ID NO:3793), KFHIDPVSD (SEQ ID NO:3794), KFHIDPVSGD (SEQ ID NO:3795), KKFHIDPVD (SEQ ID NO:3796), KKFHIDPVSD (SEQ ID NO:3797), KKFHIDPVSGD (SEQ ID NO:3798), KDADD (SEQ ID NO:3799), KDADTD (SEQ ID NO:3800), KDADTGD (SEQ ID NO:3801), KIDADD (SEQ ID NO:3802), KIDADTD (SEQ ID NO:3803), KIDADTGD (SEQ ID NO:3804), KSIDADD (SEQ ID NO:3805), KSIDADTD (SEQ ID NO:3806), KSIDADTGD (SEQ ID NO:3807), KFSIDADD (SEQ ID NO:3808), KFSIDADTD (SEQ ID NO:3809), KFSIDADTGD (SEQ ID NO:3810), KQFSIDADD (SEQ ID NO:3811), KQFSIDADTD (SEQ ID NO:3812), KQFSIDADTGD (SEQ ID NO:3813), KDSVD (SEQ ID NO:3814), KDSVSD (SEQ ID NO:3815), KDSVSGD (SEQ ID NO:3816), KIDSVD (SEQ ID NO:3817), KIDSVSD (SEQ ID NO:3818), KIDSVSGD (SEQ ID NO:3819), KHIDSVD (SEQ ID NO:3820), KHIDSVSD (SEQ ID NO:3821), KHIDSVSGD (SEQ ID NO:3822), KFHIDSVD (SEQ ID NO:3823), KFHIDSVSD (SEQ ID NO:3824), KFHIDSVSGD (SEQ ID NO:3825), KTFHIDSVD (SEQ ID NO:3826), KTFHIDSVSD (SEQ ID NO:3827), KTFHIDSVSGD (SEQ ID NO:3828), KDSND (SEQ ID NO:3829), KDSNSD (SEQ ID NO:3830), KDSNSGD (SEQ ID NO:3831), KIDSND (SEQ ID NO:3832), KIDSNSD (SEQ ID NO:3833), KIDSNSGD (SEQ ID NO:3834), KNIDSND (SEQ ID NO:3835), KNIDSNSD (SEQ ID NO:3836), KNIDSNSGD (SEQ ID NO:3837), KFNIDSND (SEQ ID NO:3838), KFNIDSNSD (SEQ ID NO:3839), KFNIDSNSGD (SEQ ID NO:3840), KAFNIDSND (SEQ ID NO:3841), KAFNIDSNSD (SEQ ID NO:3843), KAFNIDSNSGD (SEQ ID NO:3844), KDSSD (SEQ ID NO:3845), KDSSSD (SEQ ID NO:3846), KDSSSGD (SEQ ID NO:3847), KIDSSD (SEQ ID NO:3848), KIDSSSD (SEQ ID NO:3849), KIDSSSGD (SEQ ID NO:3850), KTIDSSD (SEQ ID NO:3851), KTIDSSSD (SEQ ID NO:3852), KTIDSSSGD (SEQ ID NO:3853), KFTIDSSD (SEQ ID NO:3854), KFTIDSSSD (SEQ ID NO:3855), KFTIDSSSGD (SEQ ID NO:3856), KKFTIDSSD (SEQ ID NO:3857), KKFTIDSSSD (SEQ ID NO:3858), KKFTIDSSSGD (SEQ ID NO:3859), KDEKD (SEQ ID NO:3860), KDEKND (SEQ ID NO:3861), KDEKNGD (SEQ ID NO:3862), KLDEKD (SEQ ID NO:3863), KLDEKND (SEQ ID NO:3864), KLDEKNGD (SEQ ID NO:3865), KTLDEKD (SEQ ID NO:3866), KTLDEKND (SEQ ID NO:3867), KTLDEKNGD (SEQ ID NO:3868), KFTLDEKD (SEQ ID NO:3869), KFTLDEKND (SEQ ID NO:3870), KFTLDEKNGD (SEQ ID NO:3871), KLFTLDEKD (SEQ ID NO:3872), KLFTLDEKND (SEQ ID NO:3873), KLFTLDEKNGD (SEQ ID NO:3874), KNEKD (SEQ ID NO:3875), KNEKTD (SEQ ID NO:3876), KNEKTGD (SEQ ID NO:3877), KINEKD (SEQ ID NO:3878), KINEKTD (SEQ ID NO:3879), KINEKTGD (SEQ ID NO:3880), KLINEKD (SEQ ID NO:3881), KLINEKTD (SEQ ID NO:3882), KLINEKTGD (SEQ ID NO:3883), KFLINEKD (SEQ ID NO:3884), KFLINEKTD (SEQ ID NO:3885), KFLINEKTGD (SEQ ID NO:3886), KKFLINEKD (SEQ ID NO:3887), KKFLINEKTD (SEQ ID NO:3888) and KKFLINEKTGD (SEQ ID NO:3889).

As noted above, certain preferred modulating agents comprise a peptide (containing a nonclassical cadherin CAR sequence or an analogue thereof) in which at least one terminal amino acid residue is modified (e.g., the N-terminal amino group is modified by, for example, acetylation or alkoxybenzylation and/or an amide or ester is formed at the C-terminus). It has been found, within the context of the present invention, that the addition of at least one such group to a linear or cyclic peptide modulating agent may improve the ability of the agent to modulate a nonclassical cadherin-mediated function. Certain preferred modulating agents contain modifications at the N- and C-terminal residues, such as N-Ac-IFVIDDKSG-NH$_2$ (SEQ ID NO:85), which modulates OB-cadherin mediated functions. Other CAR sequences provided herein are also preferably modified by the addition of one or more terminal groups.

The present invention further contemplates nonclassical cadherin CAR sequences from other organisms. Such CAR sequences may be identified based upon sequence similarity to the sequences provided herein, and the ability to modulate a nonclassical cadherin-mediated function such as may be confirmed as described herein.

Figure 4A:
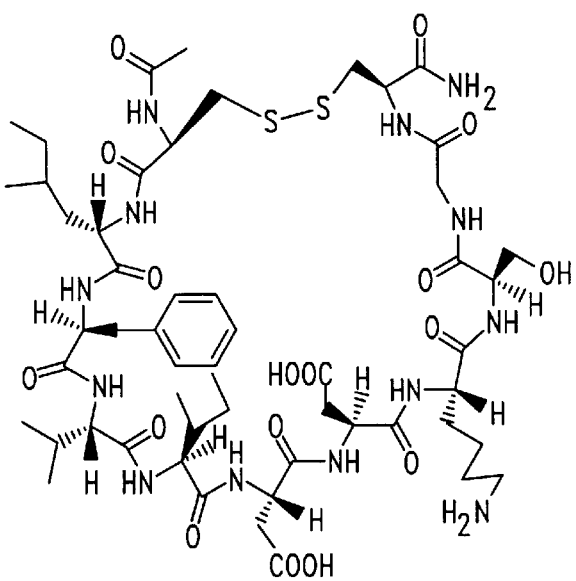
FIGS. 4A–4C provide structures of representative modulating agents (SEQ ID NOS: 85, 669–674, 676, 677, 683, 697 and 717).
Figure 4A:
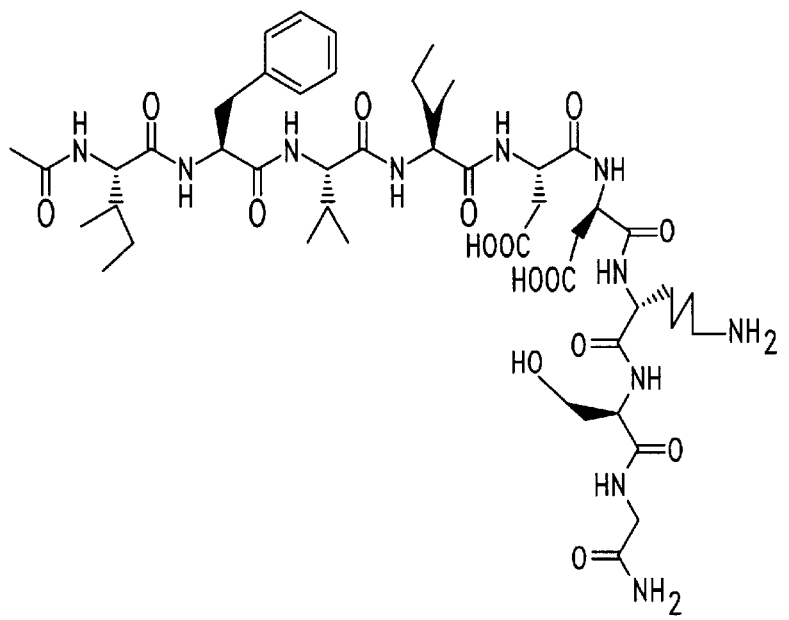
Figure 4B:
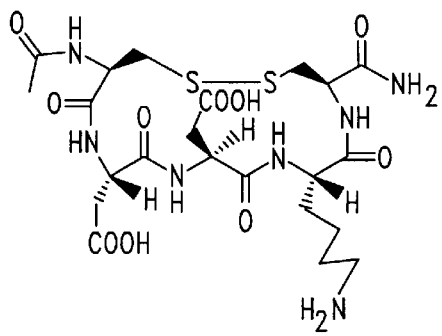
Figure 4B:
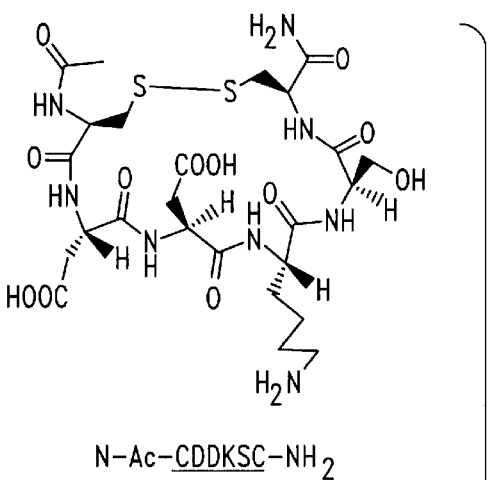
Figure 4B:
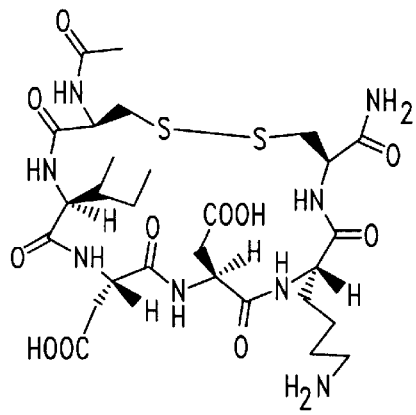
Figure 4B:
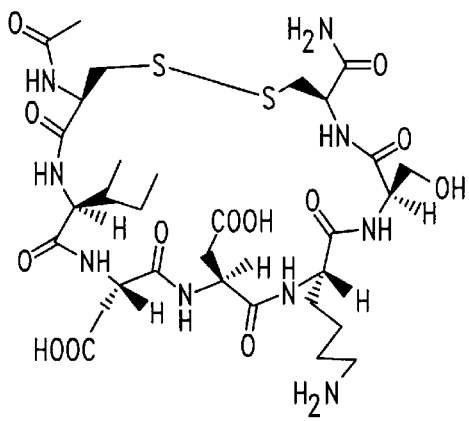
Figure 4B:
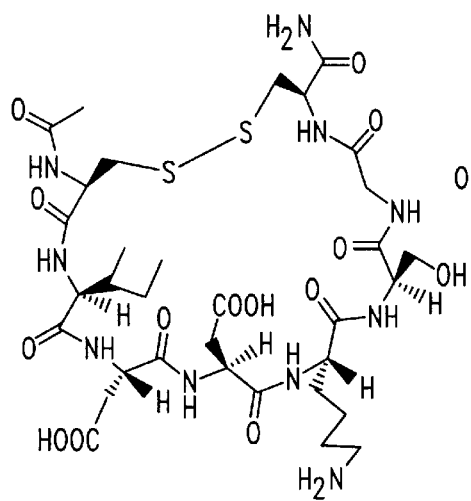
Figure 4B:
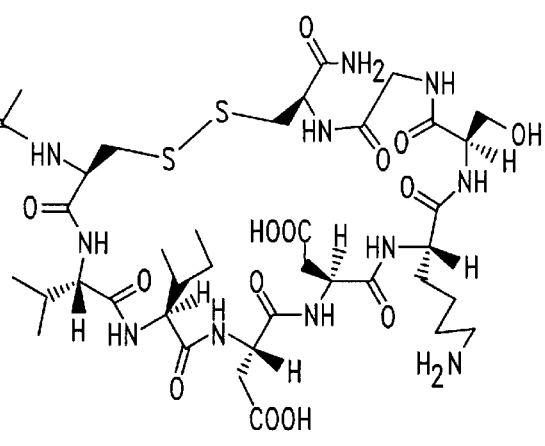
Figure 4C:
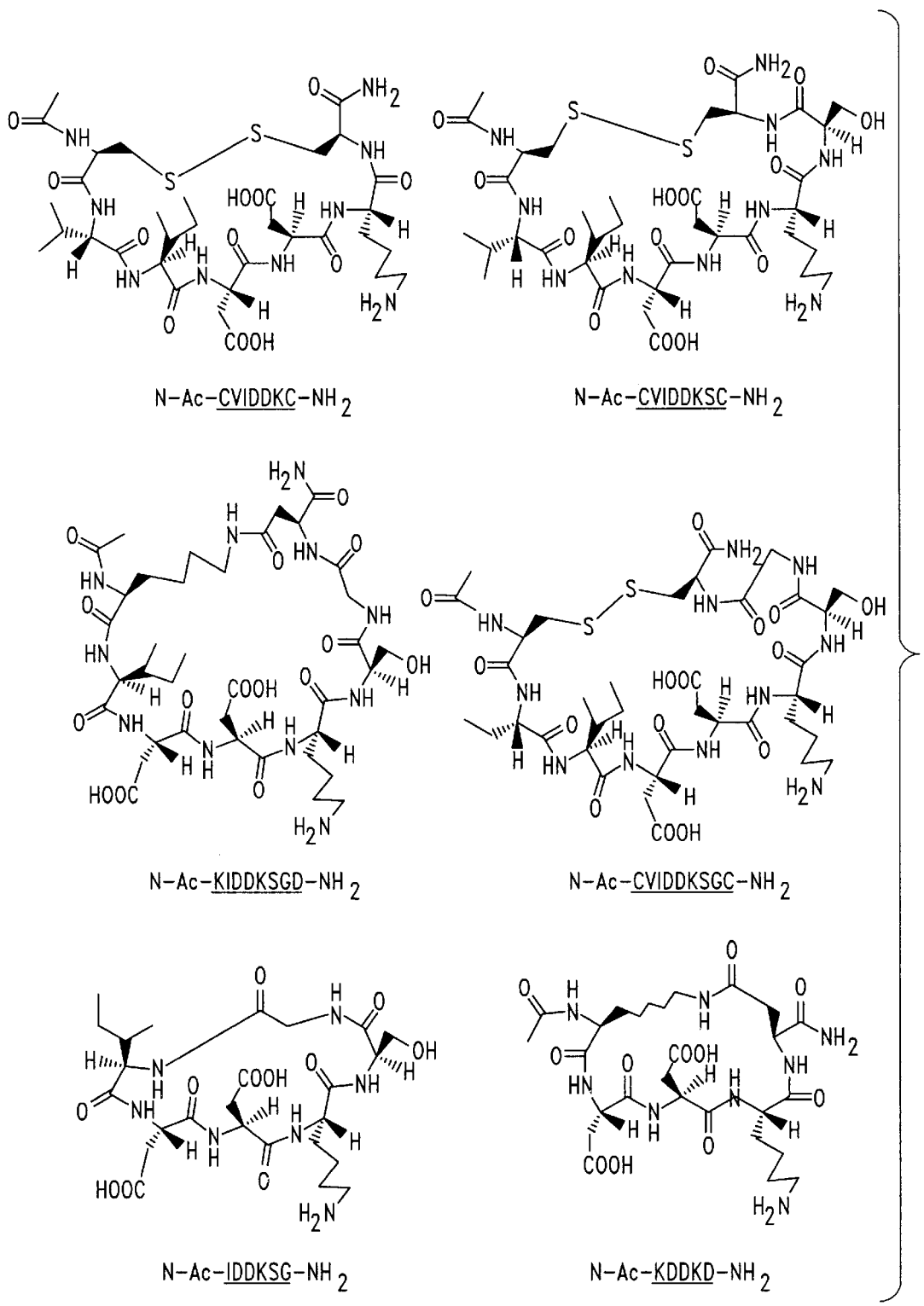

Within certain embodiments, as discussed below, cyclic pepticies that contain small CAR sequences (e.g., three residues without significant flanking sequences) are preferred for modulating nonclassical cadherin-mediated functions. Such peptides may contain an N-acetyl group and a C-amide group (e.g., the 5-residue ring N-Ac-CDDKC-NH$_2$ (SEQ ID NO:669) or N-Ac-KDDKD-NH$_2$ (SEQ ID NO:697), for modulating OB-cadherin mediated functions). Small cyclic peptides may generally be used to specifically modulate adhesion of cancer and/or other cell types by topical administration or by systemic administration, with or without linking a targeting agent to the peptide, as discussed below. Certain representative cyclic peptides comprising an OB-cadherin CAR sequence are shown in FIGS. 4A–4C. Other representative cyclic peptides comprising a nonclassical cadherin CAR sequence are shown in FIGS. 7A–7F.

Within embodiments in which inhibition of a nonclassical cadherin-interaction is desired, a modulating agent may contain one nonclassical cadherin CAR sequence, or multiple CAR sequences that are adjacent to one another (i.e., without intervening sequences) or in close proximity (i.e., separated by peptide and/or non-peptide linkers to give a distance between the nonclassical CAR sequences that ranges from about 0.1 to 400 nm). A linker may be any molecule (including peptide and/or non-peptide sequences) that does not contain a CAR sequence and that can be covalently linked to at least two peptide sequences. Using a linker, CAR sequence-containing peptides and other peptide or protein sequences may be joined end-to-end (i.e., the linker may be covalently attached to the carboxyl or amino group of each peptide sequence), and/or via side chains. One linker that can be used for such purposes is ($H_2N(CH_2)_nCO_2H$), or derivatives thereof, where n ranges from 1 to 4. Other linkers that may be used will be apparent to those of ordinary skill in the art. Peptide and non-peptide linkers may generally be incorporated into a modulating agent using any appropriate method known in the art.

Within embodiments in which enhancement of cell adhesion mediated by a nonclassical cadherin is desired, a modulating agent may contain multiple nonclassical cadherin CAR sequences, or antibodies that specifically bind to such sequences, joined by linkers as described above. For enhancers of cadherin function, the linker distance should generally be 400–10,000 nm. One linker that can be used for such purposes is ($H_2N(CH_2)_nCO_2H)_m$, or derivatives thereof, where n ranges from 1 to 10 and m ranges from 1 to 4000. For example, if glycine ($H_2NCH_2CO_2H$) or a multimer thereof is used as a linker, each glycine unit corresponds to a linking distance of 2.45 angstroms, or 0.245 nm, as determined by calculation of its lowest energy conformation when linked to other amino acids using molecular modeling techniques. Similarly, aminopropanoic acid corresponds to a linking distance of 3.73 angstroms, aminobutanoic acid to 4.96 angstroms, aminopentanoic acid to 6.30 angstroms and amino hexanoic acid to 6.12 angstroms. Enhancement of cell adhesion may also be achieved by attachment of multiple modulating agents to a support material, as discussed further below.

A modulating agent as described herein may additionally comprise one or more CAR sequences for one or more different adhesion molecules (including, but not limited to, other CAMs) and/or one or more substances, such as antibodies or fragments thereof, that bind to such sequences. Linkers may, but need not, be used to separate such CAR sequence(s) and/or antibody sequence(s) from the CAR sequence(s) and/or each other. Such modulating agents may generally be used within methods in which it is desirable to simultaneously disrupt a function mediated by multiple adhesion molecules. As used herein, an "adhesion molecule" is any molecule that mediates cell adhesion via a receptor on a cell's surface. Adhesion molecules include cell adhesion proteins (e.g., other members of the cadherin gene superfamily, such as N-cadherin and E-cadherin); integrins; extracellular matrix proteins such as laminin, fibronectin, collagens, vitronectin, entactin and tenascin; and members of the immunoglobulin supergene family, such as N-CAM. Preferred CAR sequences for inclusion within a modulating agent include the classical cadherin CAR sequence His-Ala-Val (HAV); Arg-Gly-Asp (RGD), which is bound by integrins (see Cardarelli et al., *J. Biol. Chem.* 267:23159–64, 1992); Tyr-Ile-Gly-Ser-Arg (YIGSR; SEQ ID NO:48), which is bound by α6β1 integrin; KYSFNYDGSE (SEQ ID NO:49), which is bound by N-CAM; the N-CAM heparin sulfate-binding site IWKHKGRDVILKKDVRF (SEQ ID NO:50); the putative claudin CAR sequence IYSY (SEQ ID NO:51) and/or the occludin CAR sequence LYHY (SEQ ID NO:52). Using linkers, such modulating agents may form linear or branched structures. Within one embodiment, modulating agents having a branched structure comprise four different CAR sequences, such as IFVIDDKSG (SEQ ID NO:85), RGD, YIGSR (SEQ ID NO:48) and HAV. Bi-functional modulating agents that comprise a nonclassical cadherin CAR sequence joined via a linker to a classical cadherin CAR sequence are also preferred for certain embodiments. As noted above, linkers preferably produce a distance between CAR sequences ranging from 0.1 to 10,000 nm, more preferably ranging from 0.1–400 nm. A separation distance between recognition sites may generally be determined according to the desired function of the modulating agent.

The total number of CAR sequences (including the nonclassical cadherin CAR sequence, with or without other CAR sequences derived from one or more different adhesion molecules) present within a modulating agent may range from 1 to a large number, such as 100, preferably from 1 to 10, and more preferably from 1 to 5. Peptide modulating agents comprising multiple CAR sequences typically contain from 6 (e.g., DDK-HAV) to about 1000 amino acid residues, preferably from 6 to 50 residues. When non-peptide linkers are employed, each CAR sequence of the modulating agent is present within a peptide that generally ranges in size from 3 to 50 residues in length, preferably from 4 to 25 residues, and more preferably from 5 to 15 residues.

As noted above, modulating agents may be polypeptides or salts thereof, containing only amino acid residues linked by peptide bonds, or may contain non-peptide regions, such as linkers. Peptide regions of a modulating agent may comprise residues of L-amino acids, D-amino acids, or any combination thereof. Amino acids may be from natural or non-natural sources, provided that at least one amino group and at least one carboxyl group are present in the molecule; α- and β-amino acids are generally preferred. The 20 L-amino acids commonly found in proteins are identified herein by the conventional three-letter or one-letter abbreviations, and the corresponding D-amino acids are designated by a lower case one letter symbol.

A modulating agent may also contain rare amino acids (such as 4-hydroxyproline or hydroxylysine), organic acids or amides and/or derivatives of common amino acids, such as amino acids having the C-terminal carboxylate esterified (e.g., benzyl, methyl or ethyl ester) or amidated and/or having modifications of the N-terminal amino group (e.g., acetylation or alkoxycarbonylation), with or without any of a wide variety of side-chain modifications and/or substitutions (e.g., methylation, benzylation, t-butylation, tosylation, alkoxycarbonylation, and the like). Preferred derivatives include amino acids having a C-terminal amide group. Residues other than common amino acids that may be present with a modulating agent include, but are not limited to, 2-mercaptoaniline, 2-mercaptoproline, ornithine, diaminobutyric acid, α-aminoadipic acid, m-aminomethylbenzoic acid and α,β-diaminopropionic acid.

Peptide modulating agents (and peptide portions of modulating agents) as described herein may be synthesized by methods well known in the art, including chemical synthesis and recombinant DNA methods. For modulating agents up to about 50 residues in length, chemical synthesis may be performed using solution or solid phase peptide synthesis techniques, in which a peptide linkage occurs through the direct condensation of the α-amino group of one amino acid with the α-carboxy group of the other amino acid with the elimination of a water molecule. Peptide bond synthesis by direct condensation, as formulated above, requires suppression of the reactive character of the amino group of the first and of the carboxyl group of the second amino acid. The masking substituents must permit their ready removal, without inducing breakdown of the labile peptide molecule.

In solution phase synthesis, a wide variety of coupling methods and protecting groups may be used (see Gross and Meienhofer, eds., "The Peptides: Analysis, Synthesis, Biology," Vol. 1–4 (Academic Press, 1979); Bodansky and Bodansky, "The Practice of Peptide Synthesis," 2d ed. (Springer Verlag, 1994)). In addition, intermediate purification and linear scale up are possible. Those of ordinary skill in the art will appreciate that solution synthesis requires consideration of main chain and side chain protecting groups and activation method. In addition, careful segment selection is necessary to minimize racemization during segment condensation. Solubility considerations are also a factor.

Solid phase peptide synthesis uses an insoluble polymer for support during organic synthesis. The polymer-supported peptide chain permits the use of simple washing and filtration steps instead of laborious purifications at intermediate steps. Solid-phase peptide synthesis may generally be performed according to the method of Merrifield et al., *J. Am. Chem. Soc.* 85:2149, 1963, which involves assembling a linear peptide chain on a resin support using protected amino acids. Solid phase peptide synthesis typically utilizes either the Boc or Fmoc strategy. The Boc strategy uses a 1% cross-linked polystyrene resin. The standard protecting group for α-amino functions is the tert-butyloxycarbonyl (Boc) group. This group can be removed with dilute solutions of strong acids such as 25% trifluoroacetic acid (TFA). The next Boc-amino acid is typically coupled to the amino acyl resin using dicyclohexylcarbodiimide (DCC). Following completion of the assembly, the peptide-resin is treated with anhydrous HF to cleave the benzyl ester link and liberate the free peptide. Side-chain functional groups are usually blocked during synthesis by benzyl-derived blocking groups, which are also cleaved by HF. The free peptide is then extracted from the resin with a suitable solvent, purified and characterized. Newly synthesized peptides can be purified, for example, by gel filtration, HPLC, partition chromatography and/or ion-exchange chromatography, and may be characterized by, for example, mass spectrometry or amino acid sequence analysis. In the Boc strategy, C-terminal amidated peptides can be obtained using benzhydrylamine or methylbenzhydrylamine resins, which yield peptide amides directly upon cleavage with HF.

In the procedures discussed above, the selectivity of the side-chain blocking groups and of the peptide-resin link depends upon the differences in the rate of acidolytic cleavage. Orthoganol systems have been introduced in which the side-chain blocking groups and the peptide-resin link are completely stable to the reagent used to remove the α-protecting group at each step of the synthesis. The most common of these methods involves the 9-fluorenylmethyloxycarbonyl (Fmoc) approach. Within this method, the side-chain protecting groups and the peptide-resin link are completely stable to the secondary amines used for cleaving the N-α-Fmoc group. The side-chain protection and the peptide-resin link are cleaved by mild acidolysis. The repeated contact with base makes the Merrifield resin unsuitable for Fmoc chemistry, and p-alkoxybenzyl esters linked to the resin are generally used. Deprotection and cleavage are generally accomplished using TFA.

Those of ordinary skill in the art will recognize that, in solid phase synthesis, deprotection and coupling reactions must go to completion and the side-chain blocking groups must be stable throughout the entire synthesis. In addition, solid phase synthesis is generally most suitable when peptides are to be made on a small scale.

Acetylation of the N-terminus can be accomplished by reacting the final peptide with acetic anhydride before cleavage from the resin. C-amidation is accomplished using an appropriate resin such as methylbenzhydrylamine resin using the Boc technology.

Following synthesis of a linear peptide, with or without N-acetylation and/or C-amidation, cyclization may be achieved if desired by any of a variety of techniques well known in the art. Within one embodiment, a bond may be generated between reactive amino acid side chains. For example, a disulfide bridge may be formed from a linear peptide comprising two thiol-containing residues by oxidizing the peptide using any of a variety of methods. Within one such method, air oxidation of thiols can generate disulfide linkages over a period of several days using either basic or neutral aqueous media. The peptide is used in high dilution to minimize aggregation and intermolecular side reactions. This method suffers from the disadvantage of being slow but has the advantage of only producing $H_2O$ as a side product. Alternatively, strong oxidizing agents such as I2 and $K_3Fe(CN)_6$ can be used to form disulfide linkages. Those of ordinary skill in the art will recognize that care must be taken not to oxidize the sensitive side chains of Met, Tyr, Trp or His. Cyclic peptides produced by this method require purification using standard techniques, but this oxidation is applicable at acid pHs. Oxidizing agents also allow concurrent deprotection/oxidation of suitable S-protected linear precursors to avoid premature, nonspecific oxidation of free cysteine.

DMSO, unlike $I_2$ and $K_3Fe(CN)_6$, is a mild oxidizing agent which does not cause oxidative side reactions of the nucleophilic amino acids mentioned above. DMSO is miscible with $H_2O$ at all concentrations, and oxidations can be performed at acidic to neutral pHs with harmless byproducts. Methyltrichlorosilanediphenylsulfoxide may alternatively be used as an oxidizing agent, for concurrent deprotection/oxidation of S-Acm, S-Tacm or S-t-Bu of cysteine without affecting other nucleophilic amino acids. There are no polymeric products resulting from intermolecular disulfide bond formation. Suitable thiol-containing residues for use in such oxidation methods include, but are not limited to, cysteine, β,β-dimethyl cysteine (penicillamine or Pen), β,β-tetramethylene cysteine (Tmc), β,β-pentamethylene cysteine (Pmc), β-mercaptopropionic acid (Mpr), β,β-pentamethylene-β-mercaptopropionic acid (Pmp), 2-mercaptobenzene, 2-mercaptoaniline and 2-mercaptoproline. Peptides containing such residues are illustrated by the following representative formulas, in which the nonclassical cadherin is OB-cadherin, the underlined portion is cyclized, N-acetyl groups are indicated by N—Ac and C-terminal amide groups are represented by —NH$_2$:

| | | |
|---|---|---|
| i) | N-Ac-<u>Cys-Asp-Asp-Lys-Cys</u>-NH$_2$ | (SEQ ID NO:669) |
| ii) | N-Ac-<u>Cys-Ile-Asp-Asp-Lys-Ser-Gly-Cys</u>-NH$_2$ | (SEQ ID NO:676) |
| iii) | N-Ac-<u>Cys-Ile-Asp-Asp-Lys-Cys</u>-NH$_2$ | (SEQ ID NO:670) |
| iv) | N-Ac-<u>Cys-Asp-Asp-Lys-Ser-Cys</u>-NH$_2$ | (SEQ ID NO:671) |
| v) | N-Ac-<u>Cys-Ile-Asp-Asp-Lys-Ser-Cys</u>-NH$_2$ | (SEQ ID NO:673) |
| vi) | N-Ac-<u>Cys-Asp-Asp-Lys-Ser-Cys</u>-OH | (SEQ ID NO:671) |
| vii | H-<u>Cys-Ile-Asp-Asp-Lys-Ser-Cys</u>-NH$_2$ | (SEQ ID NO:673) |
| viii) | N-Ac-<u>Cys-Asp-Asp-Lys-Pen</u>-NH$_2$ | (SEQ ID NO:71) |

-continued

| | | |
|---|---|---|
| ix) | N-Ac-Cys-Phe-Val-Ile-Asp-Asp-Lys-Ser-Gly-Cys-NH₂ | (SEQ ID NO:680) |
| x) | N-Ac-Cys-Ile-Phe-Val-Ile-Asp-Asp-Lys-Ser-Gly-Cys-NH₂ | (SEQ ID NO:683) |
| xi) | N-Ac-Ile-Tmc-Val-Ile-Asp-Asp-Lys-Ser-Cys-Glu-NH₂ | (SEQ ID NO:53) |
| xii) | N-Ac-Ile-Pmc-Val-Ile-Asp-Asp-Lys-Ser-Gly-Cys-NH₂ | (SEQ ID NO:54) |
| xiii) | Mpr-Val-Ile-Asp-Asp-Lys-Ser-Gly-Cys-NH₂ | (SEQ ID NO:55) |
| xiv) | Pmp-Val-Ile-Asp-Asp-Lys-Ser-Gly-Cys-NH₂ | (SEQ ID NO:56) | xv) 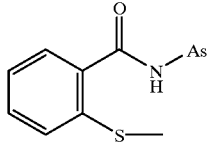

xvi) 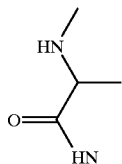

It will be readily apparent to those of ordinary skill in the art that, within each of these representative formulas, any of the above thiol-containing residues may be employed in place of one or both of the thiol-containing residues recited. Similar formulas comprising different nonclassical cadherin CAR sequences may be generated by those of ordinary skill in the art, based on the CAR sequences provided herein.

Within another embodiment, cyclization may be achieved by amide bond formation. For example, a peptide bond may be formed between terminal functional groups (i.e., the amino and carboxy termini of a linear peptide prior to cyclization). One such cyclic peptide comprising an OB-cadherin CAR sequence is IDDKSQ (SEQ ID NO:717) with or without an N-terminal acetyl group and/or a C-terminal amide. Within another such embodiment, the linear peptide comprises a D-amino acid (e.g., DDKsS; SEQ ID NO:57). Alternatively, cyclization may be accomplished by linking one terminus and a residue side chain or using two side chains, as in KDDKD (SEQ ID NO:697) or KIDDKSGD (SEQ ID NO:704), with or without an N-terminal acetyl group and/or a C-terminal amide. Residues capable of forming a lactam bond include lysine, ornithine (Orn), α-amino adipic acid, m-aminomethylbenzoic acid, α,β-diaminopropionic acid, glutamate or aspartate.

Methods for forming amide bonds are well known in the art and are based on well established principles of chemical reactivity. Within one such method, carbodiimide-mediated lactam formation can be accomplished by reaction of the carboxylic acid with DCC, DIC, EDAC or DCCI, resulting in the formation of an O-acylurea that can be reacted immediately with the free amino group to complete the cyclization. The formation of the inactive N-acylurea, resulting from O→N migration, can be circumvented by converting the O-acylurea to an active ester by reaction with an N-hydroxy compound such as 1-hydroxybenzotriazole, 1-hydroxysuccinimide, 1-hydroxynorbornene carboxamide or ethyl 2-hydroximino-2-cyanoacetate. In addition to minimizing O→N migration, these additives also serve as catalysts during cyclization and assist in lowering racemization. Alternatively, cyclization can be performed using the azide method, in which a reactive azide intermediate is generated from an alkyl ester via a hydrazide. Hydrazinolysis of the terminal ester necessitates the use of a t-butyl group for the protection of side chain carboxyl functions in the acylating component. This limitation can be overcome by using diphenylphosphoryl acid (DPPA), which furnishes an azide directly upon reaction with a carboxyl group. The slow reactivity of azides and the formation of isocyanates by their disproportionation restrict the usefulness of this method. The mixed anhydride method of lactam formation is widely used because of the facile removal of reaction by-products. The anhydride is formed upon reaction of the carboxylate anion with an alkyl chloroformate or pivaloyl chloride. The attack of the amino component is then guided to the carbonyl carbon of the acylating component by the electron donating effect of the alkoxy group or by the steric bulk of the pivaloyl chloride t-butyl group, which obstructs attack on the wrong carbonyl group. Mixed anhydrides with phosphoric acid derivatives have also been successfully used. Alternatively, cyclization can be accomplished using activated esters. The presence of electron withdrawing substituents on the alkoxy carbon of esters increases their susceptibility to aminolysis. The high reactivity of esters of p-nitrophenol, N-hydroxy compounds and polyhalogenated phenols has made these "active esters" useful in the synthesis of amide bonds. The last few years have witnessed the development of benzotriazolyloxytris-(dimethylamino) phosphonium hexafluorophosphonate (BOP) and its congeners as advantageous coupling reagents. Their performance is generally superior to that of the well established carbodiimide amide bond formation reactions.

Within a further embodiment, a thioether linkage may be formed between the side chain of a thiol-containing residue and an appropriately derivatized α-amino acid. By way of example, a lysine side chain can be coupled to bromoacetic acid through the carbodiimide coupling method (DCC, EDAC) and then reacted with the side chain of any of the thiol containing residues mentioned above to form a thioether linkage. In order to form dithioethers, any two thiol containing side-chains can be reacted with dibromoethane and diisopropylamine in DMF. Examples of thiol-containing linkages are shown below:

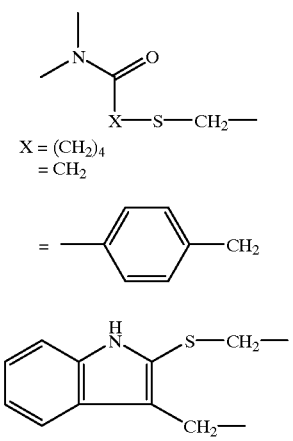

Cyclization may also be achieved using $\delta_1,\delta_1$-Ditryptophan (i.e., Ac-Trp-Gly-Gly-Trp-OMe) (SEQ ID NO:58), as shown below:

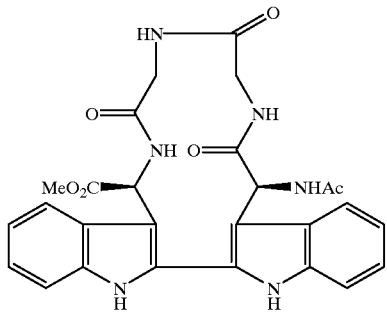

Representative structures of cyclic peptides comprising OB-cadherin CAR sequences are provided in FIGS. 4A–4C. The structures and formulas recited herein are provided solely for the purpose of illustration, and are not intended to limit the scope of the cyclic peptides described herein.

For longer modulating agents, recombinant methods are preferred for synthesis. Within such methods, all or part of a modulating agent can be synthesized in living cells, using any of a variety of expression vectors known to those of ordinary skill in the art to be appropriate for the particular host cell. Suitable host cells may include bacteria, yeast cells, mammalian cells, insect cells, plant cells, algae and other animal cells (e.g., hybridoma, CHO, myeloma). The DNA sequences expressed in this manner may encode portions of a nonclassical cadherin or other adhesion molecule, or may encode a peptide comprising a nonclassical cadherin analogue or an antibody fragment that specifically binds to a nonclassical cadherin CAR sequence. Such DNA sequences may be prepared based on known cDNA or genomic sequences, or from sequences isolated by screening an appropriate library with probes designed based on the sequences of known nonclassical cadherins. Such screens may generally be performed as described in Sambrook et al., *Molecular Cloning: A Laboratory Manual*, Cold Spring Harbor Laboratories, Cold Spring Harbor, N.Y., 1989 (and references cited therein). Polymerase chain reaction (PCR) may also be employed, using oligonucleotide primers in methods well known in the art, to isolate nucleic acid molecules encoding all or a portion of an endogenous adhesion molecule. To generate a nucleic acid molecule encoding a desired modulating agent, an endogenous cadherin sequence may be modified using well known techniques. For example, portions encoding one or more CAR sequences may be joined, with or without separation by nucleic acid regions encoding linkers, as discussed above. Alternatively, portions of the desired nucleic acid sequences may be synthesized using well known techniques, and then ligated together to form a sequence encoding the modulating agent.

As noted above, polynucleotides may also function as modulating agents. In general, such polynucleotides should be formulated to permit expression of a polypeptide modulating agent following administration to a mammal. Such formulations are particularly useful for therapeutic purposes, as described below. Those of ordinary skill in the art will appreciate that there are many ways to achieve expression of a polynucleotide within a mammal, and any suitable method may be employed. For example, a polynucleotide may be incorporated into a viral vector such as, but not limited to, adenovirus, adeno-associated virus, retrovirus, or vaccinia or other pox virus (e.g., avian pox virus). Techniques for incorporating DNA into such vectors are well known to those of ordinary skill in the art. A retroviral vector may additionally transfer or incorporate a gene for a selectable marker (to aid in the identification or selection of transfected cells) and/or a targeting moiety, such as a gene that encodes a ligand for a receptor on a specific target cell, to render the vector target specific. Targeting may also be accomplished using an antibody, by methods known to those of ordinary skill in the art. Other formulations for polynucleotides for therapeutic purposes include colloidal dispersion systems, such as macromolecule complexes, nanocapsules, microspheres, beads, and lipid-based systems including oil-in-water emulsions, micelles, mixed micelles, and liposomes. A preferred colloidal system for use as a delivery vehicle in vitro and in vivo is a liposome (i.e., an artificial membrane vesicle). The preparation and use of such systems is well known in the art.

As noted above, a modulating agent may additionally, or alternatively, comprise a substance such as an antibody or antigen-binding fragment thereof, that specifically binds to a nonclassical cadherin CAR sequence. As used herein, a substance is said to "specifically bind" to a nonclassical cadherin CAR sequence (with or without flanking amino acids) if it reacts at a detectable level with a peptide containing that sequence, and does not react detectably with peptides containing a different CAR sequence or a sequence in which the order of amino acid residues in the cadherin CAR sequence and/or flanking sequence is altered. Such antibody binding properties may generally be assessed using an ELISA, which may be readily performed by those of ordinary skill in the art and is described, for example, by Newton et al., *Develop. Dynamics* 197:1–13, 1993.

Polyclonal and monoclonal antibodies may be raised against a nonclassical cadherin CAR sequence using conventional techniques. See, e.g., Harlow and Lane, *Antibodies: A Laboratory Manual*, Cold Spring Harbor Laboratory, 1988. In one such technique, an immunogen comprising the CAR sequence is initially injected into any of a wide variety of mammals (e.g., mice, rats, rabbits, sheep or goats). The smaller immunogens (i.e., less than about 20 amino acids) should be joined to a carrier protein, such as bovine serum albumin or keyhole limpet hemocyanin. Following one or more injections, the animals are bled periodically. Polyclonal antibodies specific for the CAR sequence may then be purified from such antisera by, for example, affinity chromatography using the modulating agent or antigenic portion thereof coupled to a suitable solid support.

Monoclonal antibodies specific for a nonclassical cadherin sequence may be prepared, for example, using the technique of Kohler and Milstein, *Eur. J. Immunol.* 6:511–519, 1976, and improvements thereto. Briefly, these methods involve the preparation of immortal cell lines capable of producing antibodies having the desired specificity from spleen cells obtained from an animal immunized as described above. The spleen cells are immortalized by, for example, fusion with a myeloma cell fusion partner, preferably one that is syngeneic with the immunized animal. Single colonies are selected and their culture supernatants tested for binding activity against the modulating agent or antigenic portion thereof Hybridomas having high reactivity and specificity are preferred.

Monoclonal antibodies may be isolated from the supernatants of growing hybridoma colonies, with or without the use of various techniques known in the art to enhance the yield. Contaminants may be removed from the antibodies by conventional techniques, such as chromatography, gel filtration, precipitation and extraction. Antibodies having the desired activity may generally be identified using immunofluorescence analyses of tissue sections, cell or other samples where the target cadherin is localized.

Within certain embodiments, the use of antigen-binding fragments of antibodies may be preferred. Such fragments include Fab fragments, which may be prepared using standard techniques. Briefly, immunoglobulins may be purified from rabbit serum by affinity chromatography on Protein A bead columns (Harlow and Lane, *Antibodies: A Laboratory Manual*, Cold Spring Harbor Laboratory, 1988; see especially page 309) and digested by papain to yield Fab and Fc fragments. The Fab and Fc fragments may be separated by affinity chromatography on protein A. bead columns (Harlow and Lane, 1988, pages 628–29).

Evaluation of Modulating Agent Activity

Modulating agents as described above are capable of modulating one or more nonclassical cadherin-mediated functions. An initial screen for such activity may be performed by evaluating the ability of a modulating agent to bind to a nonclassical cadherin using any binding assay known to those of ordinary skill in the art. For example, a Pharmacia Biosensor machine may be used, as discussed in Jonsson et al., *Biotechniques* 11:520–27, 1991. For example, a modulating agent may comprise a CAR sequence that binds to a nonclassical cadherin. A specific example of a technology that measures the interaction of peptides with molecules can be found in Williams et al., *J. Biol. Chem.* 272, 22349–22354, 1997. Alternatively, real-time BIA (Biomolecular Interaction Analysis) uses the optical phenomenon surface plasmon resonance to monitor biomolecular interactions. The detection depends upon changes in the mass concentration of macromolecules at the biospecific interface, which in turn depends upon the immobilization of test molecule or peptide (referred to as the ligand) to the surface of a Biosensor chip, followed by binding of the interacting molecule (referred to as the analyte) to the ligand. Binding to the chip is measured in real-time in arbitrary units of resonance (RU).

By way of example, surface plasmon resonance experiments may be carried out using a BIAcore X™ Biosensor (Pharmacia Ltd., BIAcore, Uppsala, Sweden). Parallel flow cells of CM 5 sensor chips may be derivatized, using the amine coupling method, with streptavidin (200 µg/ml) in 10 mM Sodium Acetate, pH 4.0, according to the manufacturer's protocol. Approximately 2100–2600 resonance units (RU) of ligand may be immobilized, corresponding to a concentration of about 2.1–2.6 ng/mm$^2$. The chips may then coated be with nonclassical cadherin derivatized to biotin. Any non-specifically bound protein is removed.

To determine binding, test analytes (e.g., peptides containing the nonclassical cadherin CAR sequence) may be placed in running buffer and passed simultaneously over test and control flow cells. After a period of free buffer flow, any analyte remaining bound to the surface may be removed with, for example, a pulse of 0.1% SDS bringing the signal back to baseline. Specific binding to the derivatized sensor chips may be determined automatically by the system by subtraction of test from control flow cell responses. In general, a modulating agent binds to a nonclassical cadherin at a detectable level within such as assay. The level of binding is preferably at least that observed for the full length nonclassical cadherin under similar conditions.

The ability to modulate a nonclassical cadherin-mediated function may be evaluated using any of a variety of in vitro assays designed to measure the effect of the peptide on a response that is generally mediated by the nonclassical cadherin. As noted above, modulating agents may be capable of enhancing or inhibiting a nonclassical cadherin-mediated function.

Certain nonclassical cadherins are associated with adhesion of particular cell types (e.g., cancer cells). The ability of an agent to modulate cell adhesion may generally be evaluated in vitro by assaying the effect on adhesion between appropriate cells. In general, a modulating agent is an inhibitor of cell adhesion if contact of the test cells with the modulating agent results in a discernible disruption of cell adhesion. Modulating agents that enhance cell adhesion (e.g., agents comprising multiple nonclassical cadherin CAR sequences and/or nonclassical cadherin CAR sequences linked to a support material) are considered to be modulators of cell adhesion if they are capable of promoting cell adhesion, as judged by plating assays to assess cell adhesion to a modulating agent attached to a support material, such as tissue culture plastic.

Within certain cell adhesion assays, the addition of a modulating agent to cells that express a nonclassical cadherin results in disruption of cell adhesion. A "nonclassical cadherin-expressing cell," as used herein, may be any type of cell that expresses a nonclassical cadherin at a detectable level, using standard techniques such as immunocytochemical protocols (e.g., Blaschuk and Farookhi, *Dev. Biol.* 136:564–567, 1989). For example, such cells may be plated under standard conditions that, in the absence of modulating agent, permit cell adhesion. In the presence of modulating agent (e.g., 1 mg/mL), disruption of cell adhesion may be determined visually within 24 hours, by observing retraction of the cells from one another and the substratum.

Suitable cells for use within such assays may be any of a variety of cells that express the nonclassical cadherin of interest. Certain cells express one or more cadherins endogenously. For example, OB-cadherin-expressing cells include stromal, osteoblast and/or cancer cells. Cadherin-5 is expressed by endothelial cells, and cadherin-6 expression is associated with, for example, kidney tumor cells. Accordingly, such cell types may be used to assess the effect of modulating agents directed against OB-cadherin or cadherin-5 CAR sequences. In general, MDCK cells or keratinocytes may be used to evaluate desmocollin- or desmoglein-mediated cell adhesion. Neural cells may be used to evaluate protocadherin, cnr, PB-cadherin and type II cadherin function. It will be apparent that other cells may also be used within such assays, provided that the cells express the nonclassical cadherin of interest.

Alternatively, cells that do not naturally express a cadherin may be used within such assays. Such cells may be stably transfected with a polynucleotide (e.g., a cDNA) encoding a cadherin of interest, such that the cadherin is expressed on the surface of the cell. Expression of the cadherin may be confirmed by assessing adhesion of the transfected cells, in conjunction with immunocytochemical techniques using antibodies directed against the cadherin of interest. The stably transfected cells that aggregate, as judged by light microscopy, following transfection express sufficient levels of the nonclassical cadherin. Preferred cells for use in such assays include L cells, which do not detectably adhere and do not express any cadherin (Nagafuchi et al., Nature 329:341–343, 1987). Following transfection of L cells with a cDNA encoding a cadherin, aggregation is observed. Modulating agents that detectably inhibit such aggregation may be used to modulate functions mediated by the nonclassical cadherin. Such assays have been used for numerous nonclassical cadherins, including OB-cadherin (Okazaki et al., *J. Biol. Chem.* 269:12092–98, 1994), cadherin-5 (Breier et al., *Blood* 87:630–641, 1996), cadherin-6 (Mbalaviele et al., *J. Cell. Biol.* 141:1467–1476, 1998), cadherin-8 (Kido et al., *Genomics* 48:186–194, 1998), cadherin-15 (Shimoyama et al., *J. Biol. Chem.* 273:10011–10018, 1998), PB-cadherin (Sugimoto et al., *J. Biol. Chem.* 271:11548–11556, 1996), LI-cadherin (Kreft et al., *J. Cell. Biol.* 136:1109–1121, 1997), protocadherin 42 and 43 (Sano et al., *EMBO J.* 12:2249–2256, 1993) and desmosomal cadherins (Marcozzi et al., *J. Cell. Sci* 111:495–509, 1998). It will be apparent to those of ordinary skill in the art that assays may be performed in a similar manner for other nonclassical cadherins.

Transfection of cells for use in cell adhesion assays may be performed using standard techniques and published cadherin sequences. For example, sequences of nonclassical cadherins may be found within references cited herein and in the GenBank database. GenBank accession numbers for certain nonclassical cadherins include: X59796 (human cadherin-5); D31784 (human cadherin-6); D42150 (chicken cadherin-7); L34060 (human cadherin-8); L34056 (human OB cadherin); L34057 (human cadherin-12); U59325 (human cadherin-14); D83542 (human cadherin-15); D83348 and D88349 (rat PB-cadherin); X83228 (human LI-cadherin); L34058 (human T cadherin); L11373 (human protocadherin 43); AF029343 (human protocadherin 68); X56654 (human desmoglein 1); Z26317 and S64273 (human desmoglein 2); X72925 (human desmocollin 1); X56807 (human desmocollin 2); X83929 (human desmocollin 3); D17427 (human desmocollin 4); D86916 (mouse cadherin-related neuronal receptor 1); D86917 (mouse cadherin-related neuronal receptor 2); AB008178 (mouse cadherin-related neuronal receptor 3); AB008180 (mouse cadherin-related neuronal receptor 5); AB008181 (mouse cadherin-related neuronal receptor 6); AB008182 (mouse cadherin-related neuronal receptor 7); AB008183 (mouse cadherin-related neuronal receptor 8).

By way of example, an assay for evaluating a modulating agent for the ability to inhibit an OB-cadherin mediated function may employ MDA-231 human breast cancer cells. According to a representative procedure, the cells may be plated at 10–20,000 cells per 35 mm tissue culture flasks containing DMEM with 5% FCS and sub-cultured periodically (Sommers et al., *Cell Growth Diffn* 2:365–72, 1991). Cells may be harvested and replated in 35 mm tissue culture flasks containing 1 mm coverslips and incubated until 50–65% confluent (24–36 hours). At this time, coverslips may be transferred to a 24-well plate, washed once with fresh DMEM and exposed to modulating agent at a concentration of, for example, 1 mg/mL for 24 hours. Fresh modulating agent may then be added, and the cells left for an additional 24 hours. Cells may be fixed with 2% paraformaldehyde for 30 minutes and then washed three times with PBS. Coverslips can be mounted and viewed by phase contrast microscopy.

In the absence of modulating agent, MDA-231 cells display an epithelial-like morphology and are well attached to the substratum. MDA-231 cells that are treated with a modulating agent that disrupts OB-cadherin mediated cell adhesion may assume a round shape and become loosely attached to the substratum within 48 hours of treatment with 1 mg/mL of modulating agent.

It will be apparent that similar assays may be performed to assess a modulating agent for the ability to inhibit cell adhesion mediated by other nonclassical cadherins, using cells appropriate for the nonclassical cadherin of interest. In general, a modulating agent that is derived from a particular nonclassical cadherin CAR sequence (i.e., comprises such a CAR sequence, or an analog or mimetic thereof, or an antibody that specifically recognizes such a CAR sequence) and that modulates adhesion of a cell that expresses the same nonclassical cadherin is considered to modulate a function mediated by the nonclassical cadherin.

Other assays may be used to assess the effect of a modulating agent on specific nonclassical cadherin-mediated functions. For example, modulating agents that inhibit interactions of certain nonclassical cadherins (e.g., OB-cadherin, cadherin-5, desmogleins and desmocollins) may enhance skin permeability. This ability may be assessed by evaluating, for example, the effect of a modulating agent on permeability of adherent epithelial and/or endothelial cell layers (e.g., human skin). Such skin may be derived from a natural source or may be synthetic. Human abdominal skin for use in such assays may generally be obtained from humans at autopsy within 24 hours of death. Briefly, a modulating agent (e.g., 500 μg/ml) and a test marker (e.g., the fluorescent markers Oregon Green™ and Rhodamine Green™ Dextran) may be dissolved in a sterile buffer (e.g., phosphate buffer, pH 7.2), and the ability of the marker to penetrate through the skin and into a receptor fluid (e.g., phosphate buffer) may be measured using a Franz Cell apparatus (Franz, *Curr. Prob. Dermatol.* 7:58–68, 1978; Franz, *J. Invest. Dermatol.* 64:190–195, 1975). The penetration of the markers through the skin may be assessed at, for example, 6, 12, 24, 36, and 48 hours after the start of the experiment. In general, a modulating agent that enhances the permeability of human skin results in a statistically significant increase in the amount of marker in the receptor compartment after 6–48 hours in the presence of 500 μg/mL modulating agent.

Certain other nonclassical cadherins (e.g., cadherin-7, cadherin-8, cadherin-12, cadherin-14, cadherin-15, T-cadherin, PB-cadherin, protocadherins and cnrs) may be involved in mediating neurite growth. Agents that modulate such a function may be evaluated using a neurite outgrowth assay. Within one such assay, neurons may be cultured on a monolayer of cells (e.g., 3T3 cells) that express a nonclassical cadherin. Neurons grown on such cells (under suitable conditions and for a sufficient period of time) extend neurites that are typically, on average, twice as long as neurites extended from neurons cultured on 3T3 cells that do not express the nonclassical cadherin. Briefly, monolayers of control 3T3 fibroblasts and 3T3 fibroblasts that express a nonclassical cadherin may be established by overnight culture of 80,000 cells in individual wells of an 8-chamber well tissue culture slide. 3000 cerebellar neurons isolated from post-natal day 3 mouse brains may be cultured for 18 hours on the various monolayers in control media (SATO/ 2%FCS), or media supplemented with various concentrations of the modulating agent or control peptide. The cultures may then be fixed and stained for GAP43 which specifically binds to the neurons and their neurites. The length of the longest neurite on each GAP43 positive neuron may be measured by computer assisted morphometry.

A modulating agent may inhibit or enhance such neurite outgrowth. Under the conditions described above, the presence of 500 μg/mL of a modulating agent that disrupts neural cell adhesion should result in a decrease in the mean neurite length by at least 50%, relative to the length in the absence of modulating agent or in the presence of a negative control peptide. Alternatively, the presence of 500 μg/mL of a modulating agent that enhances neural cell adhesion should result in an increase in the mean neurite length by at least 50%.

Transfection of cells for use in a neurite outgrowth assay may be performed using standard techniques and published cadherin sequences. For example, sequences of nonclassical cadherins may be found within references cited herein and in the GenBank database. GenBank accession numbers for these cadherins are recited above.

Certain modulating agents (e.g., peptides that contain VE-cadherin and/or OB-cadherin CAR sequences, or analogues or mimetics thereof) may inhibit angiogenesis. The effect of a particular modulating agent on angiogenesis may generally be determined by evaluating the effect of the agent on blood vessel formation. Such a determination may generally be performed, for example, using a chick chorioallantoic membrane assay (Iruela-Arispe et al., *Molecular Biology of the Cell* 6:327–343, 1995). Briefly, a modulating agent may be embedded in a mesh composed of vitrogen at one or more concentrations (e.g., ranging from about 1 to 100 μg/mesh). The mesh(es) may then be applied to chick chorioallantoic membranes. After 24 hours, the effect of the modulating agent may be determined using computer assisted morphometric analysis. A modulating agent should inhibit angiogenesis by at least 25% at a concentration of 33 μg/mesh.

A myoblast fusion assay may be used as a functional assay for agents that modulate cadherin-15 function. Cadherin-15 has been shown to mediate the fusion of muscle cells into mature muscle fibers in vitro. Briefly, to perform such an assay, myoblasts may be grown in a dish, differentiation is induced, and modulating agent is added. The effect on fusion is then evaluated. In general, a modulating agent that inhibits cadherin-15 function results in a statistically significant decrease in myoblast fusion in the presence of 1 mg/mL modulating agent. Such assays may be performed as described by Pouliot et al., *Dev. Biol.* 141:292–298, 1990.

Modulating Agent Modification and Formulations

A modulating agent as described herein may, but need not, be linked to one or more additional molecules. In particular, as discussed below, it may be beneficial for certain applications to link multiple modulating agents (which may, but need not, be identical) to a support material, such as a single molecule (e.g., keyhole limpet hemocyanin) or a solid support, such as a polymeric matrix (which may be formulated as a membrane or microstructure, such as an ultra thin film), a container surface (e.g., the surface of a tissue culture plate or the interior surface of a bioreactor), or a bead or other particle, which may be prepared from a variety of materials including glass, plastic or ceramics. For certain applications, biodegradable support materials are preferred, such as cellulose and derivatives thereof, collagen, spider silk or any of a variety of polyesters (e.g., those derived from hydroxy acids and/or lactones) or sutures (see U.S. Pat. No. 5,245,012). Within certain embodiments, modulating agents and molecules comprising other CAR sequence(s) (e.g., an HAV or RGD sequence) may be attached to a support such as a polymeric matrix, preferably in an alternating pattern.

Suitable methods for linking a modulating agent to a support material will depend upon the composition of the support and the intended use, and will be readily apparent to those of ordinary skill in the art. Attachment may generally be achieved through noncovalent association, such as adsorption or affinity or, preferably, via covalent attachment (which may be a direct linkage between a modulating agent and functional groups on the support, or may be a linkage by way of a cross-linking agent). Attachment of a modulating agent by adsorption may be achieved by contact, in a suitable buffer, with a solid support for a suitable amount of time. The contact time varies with temperature, but is generally between about 5 seconds and 1 day, and typically between about 10 seconds and 1 hour.

Covalent attachment of a modulating agent to a molecule or solid support may generally be achieved by first reacting the support material with a bifunctional reagent that will also react with a functional group, such as a hydroxyl or amino group, on the modulating agent. For example, a modulating agent may be bound to an appropriate polymeric support or coating using benzoquinone, by condensation of an aldehyde group on the support with an amine and an active hydrogen on the modulating agent or by condensation of an amino group on the support with a carboxylic acid on the modulating agent. A preferred method of generating a linkage is via amino groups using glutaraldehyde. A modulating agent may be linked to cellulose via ester linkages. Similarly, amide linkages may be suitable for linkage to other molecules such as keyhole limpet hemocyanin or other support materials. Multiple modulating agents and/or molecules comprising other CAR sequences may be attached, for example, by random coupling, in which equimolar amounts of such molecules are mixed with a matrix support and allowed to couple at random.

Although modulating agents as described herein may preferentially bind to specific tissues or cells, and thus may be sufficient to target a desired site in vivo, it may be beneficial for certain applications to include an additional targeting agent. Accordingly, a targeting agent may also, or alternatively, be linked to a modulating agent to facilitate targeting to one or more specific tissues. As used herein, a "targeting agent," may be any substance (such as a compound or cell) that, when linked to a modulating agent enhances the transport of the modulating agent to a target tissue, thereby increasing the local concentration of the modulating agent. Targeting agents include antibodies or fragments thereof, receptors, ligands and other molecules that bind to cells of, or in the vicinity of, the target tissue. Known targeting agents include serum hormones, antibodies against cell surface antigens, lectins, adhesion molecules, tumor cell surface binding ligands, steroids, cholesterol, lymphokines, fibrinolytic enzymes and those drugs and proteins that bind to a desired target site. Among the many monoclonal antibodies that may serve as targeting agents are anti-TAC, or other interleukin-2 receptor antibodies; 9.2.27 and NR-ML-05, reactive with the 250 kilodalton human melanoma-associated proteoglycan; and NR-LU-10, reactive with a pancarcinoma glycoprotein. An antibody targeting agent may be an intact (whole) molecule, a fragment thereof, or a functional equivalent thereof. Examples of antibody fragments are F(ab')2, -Fab', Fab and F[v] fragments, which may be produced by conventional methods or by genetic or protein engineering. Linkage is generally covalent and may be achieved by, for example, direct condensation or other reactions, or by way of bi- or multi-functional linkers.

For certain embodiments, it may be beneficial to also, or alternatively, link a drug to a modulating agent. As used herein, the term "drug" refers to any bioactive agent intended for administration to a mammal to prevent or treat a disease or other undesirable condition. Drugs include hormones, growth factors, proteins, peptides and other compounds. The use of certain specific drugs within the context of the present invention is discussed below.

Modulating agents as described herein may be present within a pharmaceutical composition. A pharmaceutical composition comprises one or more modulating agents in combination with one or more pharmaceutically or physiologically acceptable carriers, diluents or excipients. Such compositions may comprise buffers (e.g., neutral buffered saline or phosphate buffered saline), carbohydrates (e.g., glucose, mannose, sucrose or dextrans), mannitol, proteins, polypeptides or amino acids such as glycine, antioxidants, chelating agents such as EDTA or glutathione, adjuvants (e.g., aluminum hydroxide) and/or preservatives. Within yet other embodiments, compositions of the present invention may be formulated as a lyophilizate. One or more modulating agents (alone or in combination with a targeting agent and/or drug) may, but need not, be encapsulated within liposomes using well known technology. Compositions of the present invention may be formulated for any appropriate manner of administration, including for example, topical, oral, nasal, intravenous, intracranial, intraperitoneal, subcutaneous, or intramuscular administration.

For certain embodiments, as discussed below, a pharmaceutical composition may further comprise a modulator of cell adhesion that is mediated by one or more molecules other than the particular nonclassical cadherin. Such modulators may generally be prepared as described above, using one or more CAR sequences and/or antibodies thereto. Such compositions are particularly useful for situations in which it is desirable to inhibit cell adhesion mediated by multiple cell adhesion molecules, such as other members of the cadherin gene superfamily such as the classical cadherins (e.g., N-cadherin and E-cadherin); integrins; occludin; claudins; N-CAM and/or extracellular matrix proteins such as laminin, fibronectin, collagens, vitronectin, entactin and tenascin.

A pharmaceutical composition may also, or alternatively, contain one or more drugs, which may be linked to a modulating agent or may be free within the composition. Virtually any drug may be administered in combination with a modulating agent as described herein, for a variety of purposes as described below. Examples of types of drugs that may be administered with a modulating agent include analgesics, anesthetics, antianginals, antifungals, antibiotics, anticancer drugs (e.g., taxol or mitomycin C), antiinflammatories (e.g., ibuprofen and indomethacin), anthelmintics, antidepressants, antidotes, antiemetics, antihistamines, antihypertensives, antimalarials, antimicrotubule agents (e.g., colchicine or vinca alkaloids), antimigraine agents, antimicrobials, antiphsychotics, antipyretics, antiseptics, anti-signaling agents (e.g., protein kinase C inhibitors or inhibitors of intracellular calcium mobilization), antiarthritics, antithrombin agents, antituberculotics, antitussives, antivirals, appetite suppressants, cardioactive drugs, chemical dependency drugs, cathartics, chemotherapeutic agents, coronary, cerebral or peripheral vasodilators, contraceptive agents, depressants, diuretics, expectorants, growth factors, hormonal agents, hypnotics, immunosuppression agents, narcotic antagonists, parasympathomimetics, sedatives, stimulants, sympathomimetics, toxins (e.g., cholera toxin), tranquilizers and urinary antiinfectives.

For imaging purposes, any of a variety of diagnostic agents may be incorporated into a pharmaceutical composition, either linked to a modulating agent or free within the composition. Diagnostic agents include any substance administered to illuminate a physiological function within a patient, while leaving other physiological functions generally unaffected. Diagnostic agents include metals, radioactive isotopes and radioopaque agents (e.g., gallium, technetium, indium, strontium, iodine, barium, bromine and phosphorus-containing compounds), radiolucent agents, contrast agents, dyes (e.g., fluorescent dyes and chromophores) and enzymes that catalyze a colorimetric or fluorometric reaction. In general, such agents may be attached using a variety of techniques as described above, and may be present in any orientation.

The compositions described herein may be administered as part of a sustained release formulation (i.e., a formulation such as a capsule or sponge that effects a slow release of modulating agent following administration). Such formulations may generally be prepared using well known technology and administered by, for example, oral, rectal or subcutaneous implantation, or by implantation at the desired target site. Sustained-release formulations may contain a modulating agent dispersed in a carrier matrix and/or contained within a reservoir surrounded by a rate controlling membrane (see, e.g., European Patent Application 710,491 A). Carriers for use within such formulations are biocompatible, and may also be biodegradable; preferably the formulation provides a relatively constant level of modulating agent release. The amount of modulating agent contained within a sustained release formulation depends upon the site of implantation, the rate and expected duration of release and the nature of the condition to be treated or prevented.

Pharmaceutical compositions of the present invention may be administered in a manner appropriate to the disease to be treated (or prevented). Appropriate dosages and a suitable duration and frequency of administration will be determined by such factors as the condition of the patient, the type and severity of the patient's disease and the method of administration. In general, an appropriate dosage and treatment regimen provides the modulating agent(s) in an amount sufficient to provide therapeutic and/or prophylactic benefit. Within particularly preferred embodiments of the invention, a modulating agent or pharmaceutical composition as described herein may be administered at a dosage ranging from 0.001 to 50 mg/kg body weight, preferably from 0.1 to 20 mg/kg, on a regimen of single or multiple daily doses. For topical administration, a cream typically comprises an amount of modulating agent ranging from 0.00001% to 1%, preferably 0.0001% to 0.002%. Fluid compositions typically contain about 10 ng/ml to 5 mg/ml, preferably from about 10 $\mu$g to 2 mg/mL modulating agent. Appropriate dosages may generally be determined using experimental models and/or clinical trials. In general, the use of the minimum dosage that is sufficient to provide effective therapy is preferred. Patients may generally be monitored for therapeutic effectiveness using assays suitable for the condition being treated or prevented, which will be familiar to those of ordinary skill in the art.

Modulating Agent Methods of Use

In general, the modulating agents and compositions described herein may be used for modulating a function, such as cell adhesion, of nonclassical cadherin-expressing cells. Such modulation may be performed in vitro and/or in vivo, preferably in a mammal such as a human, using any method that contacts the nonclassical cadherin-expressing cell with the modulating agent. As noted above, modulating agents for purposes that involve the disruption of nonclassical cadherin-mediated cell adhesion may comprise a nonclassical cadherin CAR sequence, multiple nonclassical cadherin CAR sequences in close proximity and/or a substance (such as an antibody or an antigen-binding fragment thereof) that recognizes a nonclassical cadherin CAR sequence. When it is desirable to also disrupt cell adhesion mediated by other adhesion molecules, a modulating agent may additionally comprise one or more CAR sequences bound by such adhesion molecules (and/or antibodies or fragments thereof that bind such sequences), preferably separated from each other and from the nonclassical cadherin CAR sequence by linkers. As noted above, such linkers may or may not comprise one or more amino acids. For enhancing cell adhesion, a modulating agent may contain multiple nonclassical cadherin CAR sequences derived from either a particular nonclassical cadherin or antibodies (or fragments), preferably separated by linkers, and/or may be linked to a single molecule or to a support material as described above. When it is desirable to also enhance cell adhesion mediated by other adhesion molecules, a modulating agent may additionally comprise one or more CAR sequences bound by such adhesion molecules (and/or antibodies or fragments thereof that bind such sequences), preferably separated from each other and from the nonclassical cadherin CAR sequence by linker.

Certain methods involving the disruption of cell adhesion as described herein have an advantage over prior techniques in that they block tumor cell adhesion. As described in greater detail below, modulating agents as described herein may also be used to disrupt or enhance cell adhesion in a variety of other contexts. Within each of the methods described herein, one or more modulating agents may generally be administered alone, or within a pharmaceutical composition. In each specific method described herein, as noted above, a targeting agent may be employed to increase the local concentration of modulating agent at the target site.

Within one aspect, methods are provided in which cell adhesion is diminished. In one such aspect, the present invention provides methods for reducing unwanted cellular adhesion in a mammal by administering a modulating agent as described herein. Unwanted cellular adhesion can occur, for example, between tumor cells, between tumor cells and normal cells or between normal cells as a result of surgery, injury, chemotherapy, disease, inflammation or other condition jeopardizing cell viability or function. Certain preferred modulating agents for use within such methods comprise one or more of the nonclassical CAR sequences provided herein. In one particularly preferred embodiment, a modulating agent is further capable of disrupting cell adhesion mediated by multiple adhesion molecules. Such an agent may comprise, in addition to one or more nonclassical cadherin CAR sequences, CAR sequences such as the classical cadherin CAR sequence HAV sequence, an RGD sequence, which is bound by integrins, the occludin CAR sequence LYHY (SEQ ID NO:52); and/or the putative claudin CAR sequence IYSY (SEQ ID NO:51), preferably separated from the nonclassical cadherin CAR sequence via a linker. Alternatively, separate modulators of cell adhesion mediated by other adhesion molecules may be administered in conjunction with the modulating agent(s), either within the same pharmaceutical composition or separately.

Topical administration of the modulating agent(s) is generally preferred, but other means may also be employed. Preferably, a fluid composition for topical administration (comprising, for example, physiological saline) comprises an amount of modulating agent as described above, and more preferably from 10 $\mu$g/mL to 1 mg/mL. Creams may generally be formulated as described above. Topical administration in the surgical field may be given once at the end of surgery by irrigation of the wound or as an intermittent or continuous irrigation with the use of surgical drains in the post-operative period or by the use of drains specifically inserted in an area of inflammation, injury or disease in cases where surgery does not need to be performed. Alternatively, parenteral or transcutaneous administration may be used to achieve similar results.

Certain modulating agents as provided herein may be used to facilitate transdermal drug delivery. Transdermal delivery of drugs is a convenient and non-invasive method that can be used to maintain relatively constant blood levels of a drug. In general, to facilitate drug delivery via the skin, it is necessary to perturb adhesion between the epithelial cells (keratinocytes) and the endothelial cells of the microvasculature. Using currently available techniques, only small, uncharged molecules may be delivered across skin in vivo. The methods described herein are not subject to the same degree of limitation. Accordingly, a wide variety of drugs may be transported across the epithelial and endothelial cell layers of skin, for systemic or topical administration. Such drugs may be delivered to melanomas or may enter the blood stream of the mammal for delivery to other sites within the body.

To enhance the delivery of a drug through the skin, a modulating agent as described herein and a drug are contacted with the skin surface. Certain preferred modulating agents for use within such methods comprise a CAR sequence (or an analogue or mimetic thereof) of OB-cadherin, cadherin-5, a desmoglein or a desmocollin. Multifunctional modulating agents comprising multiple nonclassical cadherin CAR sequences may also be used. Such modulating agents may also, or alternatively, comprise the classical cadherin CAR sequence HAV, the fibronectin CAR sequence RGD, which is recognized by integrins, and/or the occludin CAR sequence LYHY (SEQ ID NO:52). Alternatively, a separate modulator of cell adhesion may be administered in conjunction with the modulating agent(s), either within the same pharmaceutical composition or separately.

Contact may be achieved by direct application of the modulating agent, generally within a composition formulated as a cream or gel, or using any of a variety of skin contact devices for transdermal application (such as those described in European Patent Application No. 566,816 A; U.S. Pat. Nos. 5,613,958; 5,505,956). A skin patch provides a convenient method of administration (particularly for slow-release formulations). Such patches may contain a reservoir of modulating agent and drug separated from the skin by a membrane through which the drug diffuses. Within other patch designs, the modulating agent and drug may be dissolved or suspended in a polymer or adhesive matrix that is then placed in direct contact with the patient's skin. The modulating agent and drug may then diffuse from the matrix into the skin. Modulating agent(s) and drug(s) may be contained within the same composition or skin patch, or may be separately administered, although administration at the same time and site is preferred. In general, the amount of modulating agent administered via the skin varies with the nature of the condition to be treated or prevented, but may vary as described above. Such levels may be achieved by appropriate adjustments to the device used, or by applying a cream formulated as described above. Transfer of the drug across the skin and to the target tissue may be predicted based on in vitro studies using, for example, a Franz cell apparatus, and evaluated in vivo by appropriate means that will be apparent to those of ordinary skill in the art. As an example, monitoring of the serum level of the administered drug over time provides an easy measure of the drug transfer across the skin.

Transdermal drug delivery as described herein is particularly useful in situations in which a constant rate of drug delivery is desired, to avoid fluctuating blood levels of a drug. For example, morphine is an analgesic commonly used immediately following surgery. When given intermittently in a parenteral form (intramuscular, intravenous), the patient usually feels sleepy during the first hour, is well during the next 2 hours and is in pain during the last hour because the blood level goes up quickly after the injection and goes down below the desirable level before the 4 hour interval prescribed for re-injection is reached. Transdermal administration as described herein permits the maintenance of constant levels for long periods of time (e.g., days), which allows adequate pain control and mental alertness at the same time. Insulin provides another such example. Many diabetic patients need to maintain a constant baseline level of insulin which is different from their needs at the time of meals. The baseline level may be maintained using transdermal administration of insulin, as described herein. Antibiotics may also be administered at a constant rate, maintaining adequate bactericidal blood levels, while avoiding the high levels that are often responsible for the toxicity (e.g, levels of gentamycin that are too high typically result in renal toxicity).

Drug delivery by the methods of the present invention also provide a more convenient method of drug administration. For example, it is often particularly difficult to administer parenteral drugs to newborns and infants because of the difficulty associated with finding veins of acceptable caliber to catheterize. However, newborns and infants often have a relatively large skin surface as compared to adults. Transdermal drug delivery permits easier management of such patients and allows certain types of care that can presently be given only in hospitals to be given at home. Other patients who typically have similar difficulties with venous catheterization are patients undergoing chemotherapy or patients on dialysis. In addition, for patients undergoing prolonged therapy, transdermal administration as described herein is more convenient than parenteral administration.

Transdermal administration as described herein also allows the gastrointestinal tract to be bypassed in situations where parenteral uses would not be practical. For example, there is a growing need for methods suitable for administration of therapeutic small peptides and proteins, which are typically digested within the gastrointestinal tract. The methods described herein permit administration of such compounds and allow easy administration over long periods of time. Patients who have problems with absorption through their gastrointestinal tract because of prolonged ileus or specific gastrointestinal diseases limiting drug absorption may also benefit from drugs formulated for transdermal application as described herein.

Further, there are many clinical situations where it is difficult to maintain compliance. For example, patients with mental problems (e.g., patients with Alzheimer's disease or psychosis) are easier to manage if a constant delivery rate of drug is provided without having to rely on their ability to take their medication at specific times of the day. Also patients who simply forget to take their drugs as prescribed are less likely to do so if they merely have to put on a skin patch periodically (e.g., every 3 days). Patients with diseases that are without symptoms, like patients with hypertension, are especially at risk of forgetting to take their medication as prescribed.

For patients taking multiple drugs, devices for transdermal application such as skin patches may be formulated with combinations of drugs that are frequently used together. For example, many heart failure patients are given digoxin in combination with furosemide. The combination of both drugs into a single skin patch facilitates administration, reduces the risk of errors (taking the correct pills at the appropriate time is often confusing to older people), reduces the psychological strain of taking "so many pills," reduces skipped dosage because of irregular activities and improves compliance.

The methods described herein are particularly applicable to humans, but also have a variety of veterinary uses, such as the administration of growth factors or hormones (e.g., for fertility control) to an animal.

As noted above, a wide variety of drugs may be administered according to the methods provided herein. Some examples of drug categories that may be administered transderrnally include anti-inflammatory drugs (e.g., in arthritis and in other condition) such as all NSAID, indomethacin, prednisone, etc.; analgesics (especially when oral absorption is not possible, such as after surgery, and when parenteral administration is not convenient or desirable), including morphine, codeine, Demerol, acetaminophen and combinations of these (e.g., codeine plus acetaminophen); antibiotics such as Vancomycin (which is not absorbed by the GI tract and is frequently given intravenously) or a combination of INH and Rifampicin (e.g., for tuberculosis); anticoagulants such as heparin (which is not well absorbed by the GI tract and is generally given parenterally, resulting in fluctuation in the blood levels with an increased risk of bleeding at high levels and risks of inefficacy at lower levels) and Warfarin (which is absorbed by the GI tract but cannot be administered immediately after abdominal surgery because of the normal ileus following the procedure); antidepressants (e.g., in situations where compliance is an issue as in Alzheimer's disease or when maintaining stable blood levels results in a significant reduction of anti-cholinergic side effects and better tolerance by patients), such as amitriptylin, imipramin, prozac, etc.; antihypertensive drugs (e.g., to improve compliance and reduce side effects associated with fluctuating blood levels), such as diuretics and beta-blockers (which can be administered by the same patch; e.g., furosemide and propanolol); antipsychotics (e.g., to facilitate compliance and make it easier for care giver and family members to make sure that the drug is received), such as haloperidol and chlorpromazine; and anxiolytics or sedatives (e.g. to avoid the reduction of alertness related to high blood levels after oral administration and allow a continual benefit throughout the day by maintaining therapeutic levels constant).

Numerous other drugs may be administered as described herein, including naturally occurring and synthetic hormones, growth factors, proteins and peptides. For example, insulin and human growth hormone, growth factors like erythropoietin, interleukins and inteferons may be delivered via the skin.

Kits for administering a drug via the skin of a mammal are also provided within the present invention. Such kits generally comprise a device for transdermal application (e.g., a skin patch) in combination with, or impregnated with, one or more modulating agents. A drug may additionally be included within such kits.

Within a related aspect, modulating agents as described herein may be used to increase the permeability of endothelial and epithelial cell layers, thereby facilitating sampling of the blood compartment by passive diffusion. Such methods permit the detection and/or measurement of the levels of specific molecules circulating in the blood. In general, to sample the blood compartment, it is necessary to perturb adhesion between the epithelial cells (keratinocytes) and the endothelial cells of the microvasculature. Using currently available techniques, only small, uncharged molecules may be detected across skin in vivo. The methods described herein are not subject to the same degree of limitation. Accordingly, a wide variety of blood components may be sampled across epithelial and endothelial cell layers. Such sampling may be achieved across any such cell layers, including skin and gums.

For example, application of one or more modulating agents to the skin, via a skin patch as described herein, permits the patch to function like a sponge to accumulate a small quantity of fluid containing a representative sample of the serum. The patch is then removed after a specified amount of time and analyzed by suitable techniques for the compound of interest (e.g., a medication, hormone, growth factor, metabolite or marker). Alternatively, a patch may be impregnated with reagents to permit a color change if a specific substance (e.g., an enzyme) is detected. Substances that can be detected in this manner include, but are not limited to, illegal drugs such as cocaine, HIV enzymes, glucose and PSA. This technology is of particular benefit for home testing kits.

To facilitate sampling of blood in a patient, a modulating agent as described above for enhancing drug delivery is contacted with the skin surface. Modulating agent(s) and reagents for assaying blood components may, but need not, be contained within the same composition or skin patch. In general, the amount of modulating agent administered via the skin may vary as described above. Such levels may be achieved by appropriate adjustments to the device used, or by applying a cream formulated as described above. Transfer of the blood component across the skin may be predicted based on in vitro studies using, for example, a Franz cell apparatus, and evaluated in vivo by appropriate means that will be apparent to those of ordinary skill in the art.

Kits for sampling blood component via, for example, the skin or gums of a mammal, are also provided within the present invention. Such kits generally comprise a device for transdermal application (i.e., skin patch) in combination with or impregnated with, one or more modulating agents. A reagent for detection of a blood component may additionally be included within such kits.

Within a further aspect, methods are provided for enhancing delivery of a drug to a tumor in a mammal, comprising administering a modulating agent in combination with a drug to a tumor-bearing mammal. Modulating agents for use within such methods include those designed to disrupt functions mediated by OB-cadherin, cadherin-5, cadherin-6, a desmoglein and/or a desmocollin, and may further disrupt E-cadherin and/or N-cadherin mediated cell adhesion. For example, such a modulating agent may comprise a CAR sequence (or analogue or mimetic thereof) derived from one or more of the above cadherins, as described above. A modulating agent may further comprise an E- and/or N-cadherin CAR sequence (e.g., HAV, SHAVSS (SEQ ID NO:59), AHAVDI (SEQ ID NO:60) or a analogue of such a sequence). Bi-functional modulating agents that comprise the nonclassical cadherin CAR sequence with either flanking E-cadherin-specific sequences or flanking N-cadherin-specific sequences joined via a linker to the nonclassical cadherin CAR sequence are also preferred. Preferably, the peptide portion(s) of a modulating agent comprises 6–16 amino acids, since longer peptides are difficult to dissolve in aqueous solution and are more likely to be degraded by peptidases.

In one particularly preferred embodiment, a modulating agent is capable of disrupting cell adhesion mediated by multiple adhesion molecules. For example, a single branched modulating agent (or multiple agents linked to a single molecule or support material) may disrupt adhesion mediated by a nonclassical cadherin, as well as E-cadherin, N-cadherin, occludin, claudin and integrin mediated cell adhesion. Such agents serve as multifunctional disrupters of cell adhesion. Alternatively, a separate modulator may be administered in conjunction with the modulating agent(s), either within the same pharmaceutical composition or separately. Preferred antibody modulating agents include Fab fragments directed against a nonclassical or classical cadherin CAR sequence, as described above. A Fab fragment may be incorporated into a modulating agent or may be present within a separate modulator that is administered concurrently.

Preferably, the modulating agent and the drug are formulated within the same composition or drug delivery device prior to administration. In general, a modulating agent may enhance drug delivery to any tumor (e.g., breast tumor, stomach tumor, ovarian tumor or kidney tumor), and the method of administration may be chosen based on the type of target tumor. For example, injection or topical administration as described above may be preferred for melanomas and other accessible tumors (e.g., metastases from primary ovarian tumors may be treated by flushing the peritoneal cavity with the composition). Other tumors (e.g, breast tumors) may be treated by injection of the modulating agent and the drug (such as mitomycin C) into the site of the tumor. In other instances, the composition may be administered systemically, and targeted to the tumor using any of a variety of specific targeting agents. Suitable drugs may be identified by those of ordinary skill in the art based upon the type of cancer to be treated (e.g., taxol for breast cancer). In general, the amount of modulating agent administered varies with the method of administration and the nature of the tumor, within the typical ranges provided above, preferably ranging from about 1 $\mu$g/mL to about 2 mg/mL, and more preferably from about 10 $\mu$g/mL to 1 mg/mL. Transfer of the drug to the target tumor may be evaluated by appropriate means that will be apparent to those of ordinary skill in the art. Drugs may also be labeled (e.g., using radionuclides) to permit direct observation of transfer to the target tumor using standard imaging techniques.

Within a related aspect, the present invention provides methods for treating cancer and/or inhibiting metastasis in a mammal. Modulating agents for use within such methods include those designed to disrupt functions mediated by OB-cadherin, cadherin-5, cadherin-6, a desmoglein and/or a desmocollin, and may further disrupt E-cadherin, N-cadherin and/or integrin mediated cell adhesion. For example, such a modulating agent may comprise a CAR sequence (or analogue or mimetic thereof) derived from one or more of the above cadherins, as described above, optionally in combination with a sequence such as HAV, SHAVSS (SEQ ID NO:59), AHAVDI (SEQ ID NO:68), RGD, YIGSR (SEQ ID NO:48) or a derivative of such a sequence.

Preferably, the peptide portion(s) of such modulating agents comprise 6–16 amino acids. Preferred antibody modulating agents include Fab fragments directed against a nonclassical or classical cadherin CAR sequence. The Fab fragments may be either incorporated into a modulating agent or may be present within a separate modulator that is administered concurrently.

A modulating agent may be administered alone (e.g., via the skin) or within a pharmaceutical composition. For melanomas and certain other accessible tumors, injection or topical administration as described above may be preferred. For ovarian cancers, flushing the peritoneal cavity with a composition comprising one or more modulating agents may prevent metastasis of ovarian tumor cells. Other tumors (e.g., bladder tumors, bronchial tumors or tracheal tumors) may be treated by injection of the modulating agent into the cavity. In other instances, the composition may be administered systemically, and targeted to the tumor using any of a variety of specific targeting agents, as described above. Preferably, the tumor is a breast tumor, stomach tumor or kidney tumor. In general, the amount of modulating agent administered varies depending upon the method of administration and the nature of the cancer, but may vary within the ranges identified above. The effectiveness of the cancer treatment or inhibition of metastasis may be evaluated using well known clinical observations, such as monitoring the level of serum tumor markers (e.g., CEA or PSA).

The addition of a targeting agent as described above may be beneficial, particularly when the administration is systemic. Suitable modes of administration and dosages depend upon the condition to be prevented or treated but, in general, administration by injection is appropriate. Dosages may vary as described above. The effectiveness of the inhibition may be evaluated grossly by assessing the inability of the tumors to maintain their growth and microscopically by observing an absence of nerves at the periphery of the tumor.

Within further aspects, the present invention provides methods for inhibiting angiogenesis (i.e., the growth of blood vessels from pre-existing blood vessels) in a mammal. Inhibition of angiogenesis may be beneficial, for example, in patients afflicted with diseases such as cancer or arthritis. Preferred modulating agents for inhibition of angiogenesis include those that modulate functions mediated by cadherin-5, such as those that comprises a cadherin-5 CAR sequence or analogue or mimetic thereof. In addition, a modulating agent for use in inhibiting angiogenesis may comprise the sequence RGD, which is recognized by integrins, an OB-cadherin CAR sequence (e.g., DKK), the classical cadherin CAR sequence HAV, and/or the occludin CAR sequence LYHY (SEQ ID NO:52), separated from the cadherin-5 sequence via a linker. Alternatively, a separate modulator of classical cadherin-, integrin- or occludin-mediated cell adhesion may be administered in conjunction with the modulating agent(s), either within the same pharmaceutical composition or separately. The ability of a modulating agent to inhibit angiogenesis may be evaluated as described above.

The addition of a targeting agent as described above may be beneficial, particularly when the administration is systemic. Suitable modes of administration and dosages depend upon the condition to be prevented or treated but, in general, administration by injection is appropriate. Dosages may vary as described above. The effectiveness of the inhibition may be evaluated grossly by assessing the inability of the tumors to maintain their growth and microscopically by observing an absence of nerves at the periphery of the tumor.

In yet another related aspect, the present invention provides methods for inducing apoptosis in a nonclassical cadherin-expressing cell. In general, patients afflicted with cancer may benefit from such treatment. Modulating agents for use within such methods may modulate functions mediated any nonclassical cadherin(s). Such agents may comprise, for example, a CAR sequence of such a cadherin, or an analogue or mimetic thereof. In addition, such agents may comprise a sequence such as HAV, SHAVSS (SEQ ID NO:59), AHAVDI (SEQ ID NO:60), RGD, YIGSR (SEQ ID NO:48) or an analogue of such a sequence. Preferably, the peptide portion(s) of such modulating agents comprise 6–16 amino acids. Preferred antibody modulating agents include Fab fragments directed against a nonclassical or classical cadherin CAR sequence. The Fab fragments may be either incorporated into a modulating agent or within a separate modulator that is administered concurrently. Administration may be topical, via injection or by other means, and the addition of a targeting agent may be beneficial, particularly when the administration is systemic. Suitable modes of administration and dosages depend upon the location and nature of the cells for which induction of apoptosis is desired but, in general, dosages may vary as described above. A biopsy may be performed to evaluate the level of induction of apoptosis.

Within a related aspect, the present invention provides methods for treating obesity in a mammal, by using modulating agents that disrupt OB-cadherin function to inhibit adipocyte adhesion. Alternatively, modulating agents that inhibit angiogenesis as described herein may be used to inhibit fat cell growth. Modulating agents as described herein may be administered alone, or in combination with other agents, which may comprise, for example, a cadherin-5 CAR sequence, HAV, SHAVSS (SEQ ID NO:59), AHAVDI (SEQ ID NO:60), RGD or an analogue of such a sequence. Preferably the peptide portion(s) of such modulating agents comprise 6–16 amino acids. The use of Fab fragments directed against an OB-cadherin, cadherin-5 or N-cadherin CAR sequence is also preferred. A modulating agent may be administered alone (e.g., via the skin) or within a pharmaceutical composition. Injection or topical administration as described above may be preferred. In other instances, the composition may be administered systemically.

In another embodiment, methods are provided for causing the regression of blood vessels for the treatment of conditions such as cancer, psoriasis, arthritis, and age-related macular degeneration. Cancer tumors are solid masses of cells, growing out of control, which require nourishment via blood vessels. The formation of new capillaries is a prerequisite for tumor growth and the emergence of metastases. Administration of the modulating agents described herein may disrupt blood vessels and cause them to regress, thereby providing effective therapy for patients afflicted with diseases such as cancer. Certain preferred modulating agents for use within such methods comprise, in addition to a nonclassical cadherin CAR sequence (preferably an OB-cadherin or cadherin-5 CAR sequence), a sequence such as HAV and RGD, or an analogue of such a sequence. Preferably, the peptide portion(s) of such modulating agents comprise 6–16 amino acids. Preferred antibody modulating agents include Fab fragments directed against the nonclassical cadherin CAR sequence, with or without Fab fragments directed against one or more classical cadherin CAR sequences. The Fab fragments may be either incorporated into a modulating agent or within a separate modulator that is administered concurrently. Administration may be topical, via injection or by other means, and the addition of a targeting agent may be beneficial, particularly when the administration is systemic. Suitable modes of administration and dosages depend upon the location and nature of the pericytes for which disruption of cell adhesion is desired but, in general, dosages may vary as described above. The effectiveness of the cancer treatment or inhibition of metastasis may be evaluated using well known clinical observations such as the level of serum markers (e.g., CEA or PSA). The addition of a targeting agent may be beneficial, particularly when the administration is systemic. Suitable modes of administration and dosages depend upon the condition to be prevented or treated but, in general, administration by injection is appropriate. Dosages may vary as described above. The effectiveness of the inhibition may be evaluated grossly by assessing the inability of the tumor to maintain growth and microscopically by an absence of nerves at the periphery of the tumor.

Within another aspect, the present invention provides methods for enhancing drug delivery to the central nervous system (CNS) of a mammal. The blood/brain barrier is largely impermeable to most neuroactive agents, and delivery of drugs to the brain of a mammal often requires invasive procedures. Using a modulating agent as described herein, however, delivery may be by, for example, systemic administration of a modulating agent-drug-targeting agent combination, injection of a modulating agent (alone or in combination with a drug and/or targeting agent) into the carotid artery or application of a skin patch comprising a modulating agent to the head of the patient. Modulating agents for enhancing drug delivery to the central nervous system include those agents that disrupt functions mediated by OB-cadherin or cadherin-5. Certain preferred modulating agents for use within such methods are relatively small cyclic peptides (e.g., a ring size of 4–10 residues; preferably 5–7 residues). Also preferred are multi-functional modulating agents comprising a nonclassical cadherin CAR sequence and an N-cadherin CAR sequence, the putative claudin CAR sequence IYSY (SEQ ID NO:51) and/or occludin CAR sequence, preferably joined by a linker. Alternatively, a separate modulator of N-cadherin, claudin and/or occludin-mediated cell adhesion may be administered in conjunction with the modulating agent(s), either within the same pharmaceutical composition or separately. Modulating agents may further comprise antibodies or Fab fragments directed against the N-cadherin CAR sequence FHLRAHAVDINGNQV-NH$_2$ (SEQ ID NO:61). Fab fragments directed against the occludin CAR sequence GVNPTAQSSGSLYGSQIYALCNQFYT-PAATGLYVDQYLYHYCVVDPQE (SEQ ID NO:62) may also be employed, either incorporated into the modulating agent or administered concurrently as a separate modulator. In general, the amount of modulating agent administered varies with the method of administration and the nature of the condition to be treated or prevented, but typically varies as described above. Transfer of the drug to the central nervous system may be evaluated by appropriate means that will be apparent to those of ordinary skill in the art, such as magnetic resonance imaging (MRI) or PET scan (positron emitted tomography).

The present invention also provides, within further aspects, methods for enhancing and/or directing neurological growth. In one such aspect, neurite outgrowth may be enhanced and/or directed by contacting a neuron with one or more modulating agents. Modulating agents for enhancing and/or directing neurological growth include those agents that disrupt functions mediated by one or more of cadherin-7, cadherin-8, cadherin-12, cadherin-14, cadherin-15, T-cadherin, PB cadherin, a protocadherin and/or a cadherin-related neuronal receptor. Preferred modulating agents for use within such methods are linked to a polymeric matrix or other support and/or contain multiple CAR sequences separated by one or more linkers. In addition, a modulating agent comprising the cadherin CAR sequence HAV, RGD and/or YIGSR (SEQ ID NO:48), which are bound by integrins, and/or the N-CAM CAR sequence KYSFNYDGSE (SEQ ID NO:63) may further facilitate neurite outgrowth. Modulating agents comprising antibodies, or fragments thereof, may be used within this aspect of the present invention without the use of linkers or support materials. In addition, Fab fragments directed against the N-CAM CAR sequence KYSFNYDGSE (SEQ ID NO:63) or the N-cadherin CAR sequence FHLRAHAVDINGNQV-NH$_2$ (SEQ ID NO:61) may be employed, either incorporated into the modulating agent or administered concurrently as a separate modulator.

The method of achieving contact and the amount of modulating agent used will depend upon the location of the neuron and the extent and nature of the outgrowth desired. For example, a neuron may be contacted (e.g., via implantation) with modulating agent(s) linked to a support material such as a suture, fiber nerve guide or other prosthetic device such that the neurite outgrowth is directed along the support material. Alternatively, a tubular nerve guide may be employed, in which the lumen of the nerve guide contains a composition comprising the modulating agent(s). In vivo, such nerve guides or other supported modulating agents may be implanted using well known techniques to, for example, facilitate the growth of severed neuronal connections and/or to treat spinal cord injuries. It will be apparent to those of ordinary skill in the art that the structure and composition of the support should be appropriate for the particular injury being treated. In vitro, a polymeric matrix may similarly be used to direct the growth of neurons onto patterned surfaces as described, for example, in U.S. Pat. No. 5,510,628.

Within another aspect, one or more modulating agents may be used for therapy of a demyelinating neurological disease in a mammal. There are a number of demyelinating diseases, such as multiple sclerosis, characterized by oligodendrocyte death. Modulating agents for treating and/or preventing such diseases include those agents that disrupt functions mediated by one or more of cadherin-7, cadherin-8, cadherin-12, cadherin-14, cadherin-15, T-cadherin, PB cadherin, a protocadherin and/or a cnr. Modulating agents may further comprise HAV, RGD and/or YIGSR (SEQ ID NO:48), which are bound by integrins, and/or the N-CAM CAR sequence KYSFNYDGSE (SEQ ID NO:63). Such agents, when implanted with Schwann cells into the central nervous system, may facilitate Schwann cell migration and permit the practice of Schwann cell replacement therapy.

Multiple sclerosis patients suitable for treatment may be identified by criteria that establish a diagnosis of clinically definite or clinically probable MS (see Poser et al., *Ann. Neurol.* 13:227, 1983). Candidate patients for preventive therapy may be identified by the presence of genetic factors, such as HLA-type DR2a and DR2b, or by the presence of early disease of the relapsing remitting type.

Schwann cell grafts may be implanted directly into the brain along with the modulating agent(s) using standard techniques. Suitable amounts of modulating agent generally range as described above, preferably from about 10 µg/mL to about 1 mg/mL. Alternatively, a modulating agent may be implanted with oligodendrocyte progenitor cells (OPs) derived from donors not afflicted with the demyelinating disease. The myelinating cell of the CNS is the oligodendrocyte. Although mature oligodendrocytes and immature cells of the oligodendrocyte lineage, such as the oligodendrocyte type 2 astrocyte progenitor, have been used for transplantation, OPs are more widely used. OPs are highly motile and are able to migrate from transplant sites to lesioned areas where they differentiate into mature myelin-forming oligodendrocytes and contribute to repair of demyelinated axons (see e.g., Groves et al., *Nature* 362:453–55, 1993; Baron-Van Evercooren et al., *Glia* 16:147–64, 1996). OPs can be isolated using routine techniques known in the art (see e.g., Milner and French-Constant, *Development* 120:3497–3506, 1994), from many regions of the CNS including brain, cerebellum, spinal cord, optic nerve and olfactory bulb. Substantially greater yields of OP's are obtained from embryonic or neonatal rather than adult tissue. OPs may be isolated from human embryonic spinal cord and cultures of neurospheres established. Human fetal tissue is a potential valuable and renewable source of donor OP's for future, long range transplantation therapies of demyelinating diseases such as MS.

OPs can be expanded in vitro if cultured as "homotypic aggregates" or "spheres" (Avellana-Adalid et al, *J. Neurosci. Res.* 45:558–70, 1996). Spheres (sometimes called "oligospheres" or "neurospheres") are formed when OPs are grown in suspension in the presence of growth factors such as PDGF and FGF. OPs can be harvested from spheres by mechanical dissociation and used for subsequent transplantation or establishment of new spheres in culture. Alternatively, the spheres themselves may be transplanted, providing a "focal reservoir" of OPs (Avellana-Adalid et al, *J. Neurosci. Res.* 45:558–70, 1996).

An alternative source of OP may be spheres derived from CNS stem cells. Recently, Reynolds and Weiss, *Dev. Biol.* 165:1–13, 1996 have described spheres formed from EGF-responsive cells derived from embryonic neuroepithelium, which appear to retain the pluripotentiality exhibited by neuroepithelium in vivo. Cells dissociated from these spheres are able to differentiate into neurons, oligodendrocytes and astrocytes when plated on adhesive substrates in the absence of EGF, suggesting that EGF-responsive cells derived from undifferentiated embryonic neuroepithelium may represent CNS stem cells (Reynolds and Weiss, *Dev. Biol.* 165:1–13, 1996). Spheres derived from CNS stem cells provide an alternative source of OP which may be manipulated in vitro for transplantation in vivo. Spheres composed of CNS stern cells may further provide a microenvironment conducive to increased survival, migration, and differentiation of the OPs in vivo.

The use of neurospheres for the treatment of MS may be facilitated by modulating agents that enhance cell migration from the spheres. In the absence of modulating agent, the cells within the spheres adhere tightly to one another and migration out of the spheres is hindered. Modulating agents that disrupt N-cadherin mediated cell adhesion as described herein, when injected with neurospheres into the central nervous system, may improve cell migration and increase the efficacy of OP replacement therapy. Neurosphere grafts may be implanted directly into the central nervous system along with the modulating agent(s) using standard techniques.

Alternatively, a modulating agent may be administered alone or within a pharmaceutical composition. The duration and frequency of administration will be determined by such factors as the condition of the patient, and the type and severity of the patient's disease. Within particularly preferred embodiments of the invention, the modulating agent or pharmaceutical composition may be administered at a dosage ranging from 0.1 mg/kg to 20 mg/kg although appropriate dosages may be determined by clinical trials. Methods of administration include injection, intravenous or intrathecal (i.e., directly in cerebrospinal fluid). A modulating agent or pharmaceutical composition may further comprise a drug (e.g., an immunomodulatory drug).

Effective treatment of multiple sclerosis may be evidenced by any of the following criteria: EDSS (extended disability status scale), appearance of exacerbations or MRI (magnetic resonance imaging). The EDSS is a means to grade clinical impairment due to MS (Kurtzke, *Neurology* 33:1444, 1983), and a decrease of one full step defines an effective treatment in the context of the present invention (Kurtzke, *Ann. Neurol.* 36:573–79, 1994). Exacerbations are defined as the appearance of a new symptom that is attributable to MS and accompanied by an appropriate new neurologic abnormality (Sipe et al., *Neurology* 34:1368, 1984). Therapy is deemed to be effective if there is a statistically significant difference in the rate or proportion of exacerbation-free patients between the treated group and the placebo group or a statistically significant difference in the time to first exacerbation or duration and severity in the treated group compared to control group. MRI can be used to measure active lesions using gadolinium-DTPA-enhanced imaging (McDonald et al. *Ann. Neurol.* 36:14, 1994) or the location and extent of lesions using $T_2$-weighted techniques. The presence, location and extent of MS lesions may be determined by radiologists using standard techniques. Improvement due to therapy is established when there is a statistically significant improvement in an individual patient compared to baseline or in a treated group versus a placebo group.

Efficacy of the modulating agent in the context of prevention may be judged based on clinical measurements such as the relapse rate and EDSS. Other criteria include a change in area and volume of T2 images on MRI, and the number and volume of lesions determined by gadolinium enhanced images.

The present invention also provides methods for increasing vasopermeability in a mammal by administering one or more modulating agents or pharmaceutical compositions. Modulating agents as described herein that decrease OB-cadherin and/or cadherin-5 mediate cell adhesion may be used to increase vascular permeability. Certain preferred modulating agents for use within such methods further inhibit N-cadherin, claudin and/or occludin mediated adhesion. Such agents may comprise, in addition to an OB-cadherin and/or cadherin-5 CAR sequence, a sequence such as LYHY (the occludin CAR sequence; SEQ ID NO:52), IYSY (the putative claudin CAR sequence; SEQ ID NO:51) HAV and RGD, or an analogue of such a sequence. Preferably, the peptide portion(s) of such modulating agents comprise 6–16 amino acids. Preferred antibody modulating agents include Fab fragments directed against one or more of the OB-cadherin, cadherin-5, classical cadherin, claudin and/or occludin CAR sequences. The Fab fragments may be either incorporated into a modulating agent or within a separate modulator that is administered concurrently.

Treatment with a modulating agent may be appropriate, for example, prior to administration of an anti-tumor therapeutic or diagnostic agent (e.g., a monoclonal antibody or other macromolecule), an antimicrobial agent or an anti-inflammatory agent, in order to increase the concentration of such agents in the vicinity of the target tumor, organism or inflammation without increasing the overall dose to the patient. Modulating agents for use within such methods may be linked to a targeting agent to further increase the local concentration of modulating agent, although systemic administration of a vasoactive agent even in the absence of a targeting agent increases the perfusion of certain tumors relative to other tissues. Suitable targeting agents include antibodies and other molecules that specifically bind to tumor cells or to components of structurally abnormal blood vessels. For example, a targeting agent may be an antibody that binds to a fibrin degradation product or a cell enzyme such as a peroxidase that is released by granulocytes or other cells in necrotic or inflamed tissues.

Administration via intravenous injection or transdermal administration is generally preferred. Effective dosages are generally sufficient to increase localization of a subsequently administered diagnostic or therapeutic agent to an extent that improves the clinical efficacy of therapy of accuracy of diagnosis to a statistically significant degree. Comparison may be made between treated and untreated tumor host animals to whom equivalent doses of the diagnostic or therapeutic agent are administered. In general, dosages range as described above.

In certain other aspects, the present invention provides methods for enhancing adhesion of nonclassical cadherin-expressing cells. Within certain embodiments, a modulating agent may be linked to a solid support, resulting in a matrix that comprises multiple modulating agents. Within one such embodiment, the support is a polymeric matrix to which modulating agents and molecules comprising other CAR sequence(s) are attached (e.g., modulating agents and molecules comprising either HAV or RGD sequences may be attached to the same matrix, preferably in an alternating pattern). Such matrices may be used in contexts in which it is desirable to enhance adhesion mediated by multiple cell adhesion molecules. Alternatively, the modulating agent itself may comprise multiple nonclassical cadherin CAR sequences or antibodies (or fragments thereof), separated by linkers as described above. Either way, the modulating agent(s) function as a "biological glue" to bind multiple nonclassical cadherin-expressing cells within a variety of contexts.

Within one such aspect, modulating agents comprising the nonclassical cadherin CAR sequence and/or multiple modulating agents linked to a single molecule or support material may be used to facilitate wound healing and/or reduce scar tissue in a mammal. Peptides that may be linked to a support, and/or to one another via a linker, to generate a suitable modulating agent include, but are not limited to, one or more nonclassical cadherin CAR sequences, or analogues or mimetics thereof. Suitable nonclassical CAR sequences include OB-cadherin, cadherin-5, desmoglein and/or desmocollin CAR sequences. Such nonclassical CAR sequences may be used in combination with one or more classical cadherin CAR sequences, including HAV, SHAVSS (SEQ ID NO:59), AHAVDI (SEQ ID NO:60), or an analogue of such a sequence. Preferred antibody modulating agents include Fab fragments directed against either the nonclassical cadherin or E-cadherin CAR sequences. Modulating agents that are linked to a biocompatible and biodegradable matrix such as cellulose or collagen are particularly preferred. For use within such methods, a modulating agent should have a free amino or hydroxyl group. The modulating agents are generally administered topically to the wound, where they may facilitate closure of the wound and may augment, or even replace, stitches. Similarly, administration of matrix-linked modulating agents may facilitate cell adhesion in skin grafting and prosthetic implants, and may prolong the duration and usefulness of collagen injection. In general, the amount of matrix-linked modulating agent administered to a wound, graft or implant site varies with the severity of the wound and/or the nature of the wound, graft, or implant, but may vary as discussed above. Multi-functional modulating agents comprising a nonclassical cadherin sequence, a classical cadherin CAR sequence (HAV), and the CAR sequence bound by certain integrins (RGD) may also be used as potent stimulators of wound healing and/or to reduce scar tissue. Alternatively, one or more separate modulators of classical cadherin- or integrin-mediated cell adhesion may be administered in conjunction with the modulating agent(s), either within the same pharmaceutical composition or separately.

Within another aspect, one or more modulating agents may be linked to the interior surface of a tissue culture plate or other cell culture support, such as for use in a bioreactor. Such linkage may be performed by any suitable technique, as described above. Modulating agents linked in this fashion may generally be used to immobilize cadherin-expressing cells. For example, dishes or plates coated with one or more modulating agents may be used to immobilize cadherin-expressing cells within a variety of assays and screens. Within bioreactors (ie., systems for large scale production of cells or organoids), modulating agents may generally be used to improve cell attachment and stabilize cell growth. Modulating agents may also be used within bioreactors to support the formation and function of highly differentiated organoids derived, for example, from dispersed populations of fetal mammalian cells. Bioreactors containing biomatrices of modulating agent(s) may also be used to facilitate the production of specific proteins.

Modulating agents as described herein may be used within a variety of bioreactor configurations. In general, a bioreactor is designed with an interior surface area sufficient to support large numbers of adherent cells. This surface area can be provided using membranes, tubes, microtiter wells, columns, hollow fibers, roller bottles, plates, dishes, beads or a combination thereof. A bioreactor may be compartmentalized. The support material within a bioreactor may be any suitable material known in the art; preferably, the support material does not dissolve or swell in water. Preferred support materials include, but are not limited to, synthetic polymers such as acrylics, vinyls, polyethylene, polypropylene, polytetrafluoroethylene, nylons, polyurethanes, polyamides, polysulfones and poly(ethylene terephthalate); ceramics; glass and silica.

Within a further aspect, modulating agents as described herein may be used for controlled inhibition of synaptic stability, resulting in increased synaptic plasticity. Within this aspect, administration of one or more modulating agents that inhibit cnr-mediated cell adhesion may be advantageous for repair processes within the brain, as well as learning and memory, in which neural plasticity is a key early event in the remodeling of synapses. In addition, a preferred modulating agent may comprise one or more additional CAR sequences, such as HAV, RGD and/or the N-CAM CAR sequence KYSFNYDGSE (SEQ ID NO:63). As noted above, such additional sequence(s) may be separated from the nonclassical CAR sequence via a linker. Alternatively, a separate modulator of cell adhesion mediated by a different adhesion molecule may be administered in conjunction with the modulating agent(s), either within the same pharmaceutical composition or separately. For such aspects, administration may be via encapsulation into a delivery vehicle such as a liposome, using standard techniques, and injection into, for example, the carotid artery. Alternatively, a modulating agent may be linked to a disrupter of the blood-brain barrier. In general dosages range as described above.

Within further aspects, modulating agents as described herein may be used for modulating the immune system of a mammal in any of several ways. Cadherins are expressed on immature B and T cells (thymocytes and bone marrow pre-B cells), as well as on specific subsets of activated B and T lymphocytes and some hematological malignancies. Modulating agents may generally be used to modulate specific steps within cellular interactions during an immune response or during the dissemination of malignant lymphocytes.

For example, a modulating agent as described herein may be used to treat diseases associated with excessive generation of otherwise normal T cells. Without wishing to be bound by any particular theory, it is believed that the interaction of cadherins on maturing T cells and B cell subsets contributes to protection of these cells from programmed cell death. A modulating agent may decrease such interactions, leading to the induction of programmed cell death. Accordingly, modulating agents may be used to treat certain types of diabetes and rheumatoid arthritis, particularly in young children where the cadherin expression on thymic pre-T cells is greatest.

Modulating agents may also be administered to patients afflicted with certain skin disorders (such as cutaneous lymphomas), acute B cell leukemia and excessive immune reactions involving the humoral immune system and generation of immunoglobulins, such as allergic responses and antibody-mediated graft rejection. In addition, patients with circulating cadherin-positive malignant cells (e.g., during regimes where chemotherapy or radiation therapy is eliminating a major portion of the malignant cells in bone marrow and other lymphoid tissue) may benefit from treatment with a modulating agent. Such treatment may also benefit patients undergoing transplantation with peripheral blood stem cells.

Preferred modulating agents for use within such methods include those that disrupt OB-cadherin, cadherin-5, cadherin-6 and/or cadherin-8 mediated cell adhesion. In addition, a preferred modulating agent may comprise one or more additional CAR sequences, such as HAV, RGD, LYHY (SEQ ID NO:52) and/or KYSFNYDGSE (SEQ ID NO:63). As noted above, such additional sequence(s) may be separated from a nonclassical CAR sequence via a linker. Alternatively, a separate modulator of classical cadherin-, occludin-, integrin- and/or N-CAM-mediated cell adhesion may be administered in conjunction with the modulating agent(s), either within the same pharmaceutical composition or separately.

Within the above methods, the modulating agent(s) are preferably administered systemically (usually by injection) or topically. A modulating agent may be linked to a targeting agent. For example, targeting to the bone marrow may be beneficial. A suitable dosage is sufficient to effect a statistically significant reduction in the population of B and/or T cells that express cadherin and/or an improvement in the clinical manifestation of the disease being treated. Typical dosages generally range as described above.

Within further aspects, the present invention provides methods and kits for preventing pregnancy in a mammal. In general, disruption of OB-cadherin function prevents the adhesion of trophoblasts and their subsequent fusion to form syncitiotrophoblasts, whereas disruption of cadherin-5 function prevents angiogenesis. In one embodiment, one or more modulating agents may be incorporated into any of a variety of well known contraceptive devices, such as sponges suitable for intravaginal insertion (see, e.g., U.S. Pat. No. 5,417,224) or capsules for subdermal implantation. Other modes of administration are possible, however, including transdermal administration, for modulating agents linked to an appropriate targeting agent. Preferred modulating agents for use within such methods include those comprising an OB-cadherin and/or cadherin-5 CAR sequence, or analogue or mimetic thereof. In addition, a preferred modulating agent may comprise additional CAR sequences, such as HAV and/or RGD. As noted above, such additional sequences may be separated from the nonclassical CAR sequence via a linker. Alternatively, a separate modulator of classical cadherin- and/or integrin-mediated cell adhesion may be administered in conjunction with the modulating agent(s), either within the same pharmaceutical composition or separately.

Suitable methods for incorporation into a contraceptive device depend upon the type of device and are well known in the art. Such devices facilitate administration of the modulating agent(s) to the uterine region and may provide a sustained release of the modulating agent(s). In general, modulating agent(s) may be administered via such a contraceptive device at a dosage ranging from 0.1 to 50 mg/kg, although appropriate dosages may be determined by monitoring hCG levels in the urine. hCG is produced by the placenta, and levels of this hormone rise in the urine of pregnant women. The urine hCG levels can be assessed by radio-immunoassay using well known techniques. Kits for preventing pregnancy generally comprise a contraceptive device impregnated with one or more modulating agents.

Alternatively, a sustained release formulation of one or more modulating agents may be implanted, typically subdermally, in a mammal for the prevention of pregnancy. Such implantation may be performed using well known techniques. Preferably, the implanted formulation provides a dosage as described above, although the minimum effective dosage may be determined by those of ordinary skill in the art using, for example, an evaluation of hCG levels in the urine of women.

Other aspects of the present invention provide methods that employ antibodies raised against the nonclassical CAR sequences for diagnostic and assay purposes. Assays typically involve using an antibody to detect the presence or absence of a nonclassical cadherin (free or on the surface of a cell), or proteolytic fragments containing one or more EC domains in a suitable biological sample, such as tumor or normal tissue biopsies, blood, lymph node, serum or urine samples, or other tissue, homogenate, or extract thereof obtained from a patient.

There are a variety of assay formats known to those of ordinary skill in the art for using an antibody to detect a target molecule in a sample. See, e.g., Harlow and Lane, *Antibodies: A Laboratory Manual*, Cold Spring Harbor Laboratory, 1988. For example, the assay may be performed in a Western blot format, wherein a protein preparation from the biological sample is submitted to gel electrophoresis, transferred to a suitable membrane and allowed to react with the antibody. The presence of the antibody on the membrane may then be detected using a suitable detection reagent, as described below.

In another embodiment, the assay involves the use of antibody immobilized on a solid support to bind to the target cadherin, or a proteolytic fragment containing an extracellular domain and encompassing a CAR sequence, and remove it from the remainder of the sample. The bound cadherin may then be detected using a second antibody or reagent that contains a reporter group. Alternatively, a competitive assay may be utilized, in which a cadherin is labeled with a reporter group and allowed to bind to the immobilized antibody after incubation of the antibody with the sample. The extent to which components of the sample inhibit the binding of the labeled cadherin to the antibody is indicative of the reactivity of the sample with the immobilized antibody, and as a result, indicative of the level of the cadherin in the sample.

The solid support may be any material known to those of ordinary skill in the art to which the antibody may be attached, such as a test well in a microtiter plate, a nitrocellulose filter or another suitable membrane. Alternatively, the support may be a bead or disc, such as glass, fiberglass, latex or a plastic such as polystyrene or polyvinylchloride. The antibody may be immobilized on the solid support using a variety of techniques known to those in the art, which are amply described in the patent and scientific literature.

In certain embodiments, the assay for detection of a nonclassical cadherin in a sample is a two-antibody sandwich assay. This assay may be performed by first contacting an antibody that has been immobilized on a solid support, commonly the well of a microtiter plate, with the biological sample, such that the nonclassical cadherin within the sample is allowed to bind to the immobilized antibody (a 30 minute incubation time at room temperature is generally sufficient). Unbound sample is then removed from the immobilized cadherin-antibody complexes and a second antibody (containing a reporter group such as an enzyme, dye, radionuclide, luminescent group, fluorescent group or biotin) capable of binding to a different site on the cadherin is added. The amount of second antibody that remains bound to the solid support is then determined using a method appropriate for the specific reporter group. The method employed for detecting the reporter group depends upon the nature of the reporter group. For radioactive groups, scintillation counting or autoradiographic methods are generally appropriate. Spectroscopic methods may be used to detect dyes, luminescent groups and fluorescent groups. Biotin may be detected using avidin, coupled to a different reporter group (commonly a radioactive or fluorescent group or an enzyme). Enzyme reporter groups may generally be detected by the addition of substrate (generally for a specific period of time), followed by spectroscopic or other analysis of the reaction products. Standards and standard additions may be used to determine the level of cadherin in a sample, using well known techniques.

The present invention also provides kits for use in such immunoassays. Such kits generally comprise one or more antibodies, as described above. In addition, one or more additional compartments or containers of a kit generally enclose elements, such as reagents, buffers and/or wash solutions, to be used in the immunoassay.

Within further aspects, modulating agents or antibodies (or fragments thereof) may be used to facilitate cell identification and sorting in vitro or imaging in vivo, permitting the selection of cells expressing the nonclassical cadherin (or different nonclassical cadherin levels). Preferably, the modulating agent(s) or antibodies for use in such methods are linked to a detectable marker. Suitable markers are well known in the art and include radionuclides, luminescent groups, fluorescent groups, enzymes, dyes, constant immunoglobulin domains and biotin. Within one preferred embodiment, a modulating agent linked to a fluorescent marker, such as fluorescein, is contacted with the cells, which are then analyzed by fluorescence activated cell sorting (FACS).

Antibodies or fragments thereof may also be used within screens of combinatorial or other nonpeptide-based libraries to identify other compounds capable of modulating nonclassical cadherin-mediated cell adhesion. Such screens may generally be performed using an ELISA or other method well known to those of ordinary skill in the art that detect compounds with a shape and structure similar to that of the modulating agent. In general, such screens may involve contacting an expression library producing test compounds with an antibody, and detecting the level of antibody bound to the candidate compounds. Compounds for which the antibody has a higher affinity may be further characterized as described herein, to evaluate the ability to modulate OB-cadherin-mediated cell adhesion.

The following examples are offered by way of illustration and not by way of limitation.

EXAMPLES

Example 1
Preparation of Representative Modulating Agents

This Example illustrates the solid phase synthesis of representative peptide modulating agents.

The peptides were synthesized on a 431A Applied Biosystems peptide synthesizer using p-Hydroxymethylphenoxymethyl polystyrene (HMP) resin and standard Fmoc chemistry. After synthesis and deprotection, the peptides were de-salted on a Sephadex G-10 column and lyophilized. The peptides were analyzed for purity by analytical HPLC, and in each case a single peak was observed. Peptides were made as stock solutions at 10 to 25 mg/mL in dimethylsulfoxide (DMSO) or water and stored at −20° C. before use.

Example 2
Disruption of Human Breast Cancer Cell Adhesion

This Example illustrates the ability of a representative linear peptide comprising an OB-cadherin CAR sequence to disrupt human breast epithelial cell adhesion.

Figure 5A:
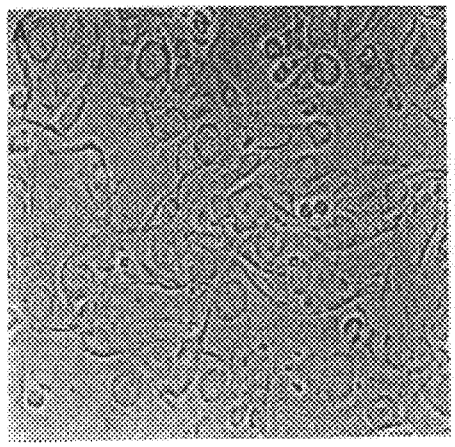
FIGS. 5A–5C are photographs showing cultures of human breast cancer cells in the presence (FIGS. 5B and 5C) and absence (FIG. 5A) of a representative linear peptide modulating agent.
Figure 5B:
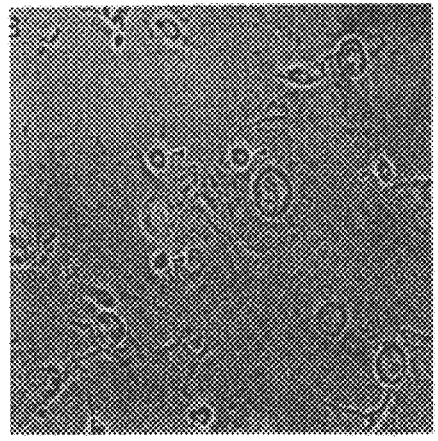
Figure 5C:
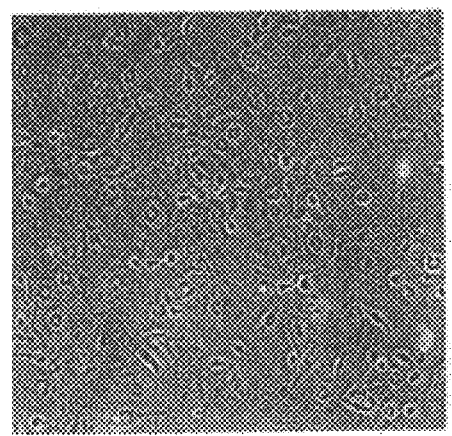

MDA-MB-231 human breast cancer cells (Lombardi Cancer Research Center, Washington, D.C.) were used in these experiments. They express cadherin-11 (also known as OB-cadherin) but not N-cadherin or E-cadherin. The cells were plated (~50,000 cells) on glass coverslips and cultured for 24 hours in DMEM containing 5% serum. Peptides (N-Ac-IFVIDDKSG-NH$_2$ (SEQ ID NO:85) and H-IFVIDDKSG-OH (SEQ ID NO:85)) were dissolved in sterile water (10 mg/ml), and 100 µl of each peptide stock solution was added to 1 ml of DMEM containing 5% serum. Control cells had 100 µl of water added to the medium. Cells were monitored by phase contrast microscopy. After 24 hours cells were fixed in formaldehyde. After 24 hours, neither the peptide H-IFVIDDKSG-OH (SEQ ID NO:85) nor water had an effect on cell morphology (FIG. 5A). The cells treated with either water or H-IFVIDDKSG-OH (SEQ ID NO:85) remained flattened and well-attached to the substratum. In contrast, the cells treated with N-Ac-IFVIDDKSG-NH$_2$ (SEQ ID NO:85) rounded up from each other and were not well-attached to the substratum (FIGS. 5A and 5B; arrows indicate rounded cells). These results demonstrate that the peptide N-Ac-IFVIDDKSG-NH$_2$ (SEQ ID NO:85) interferes with cell adhesion. The amino acid sequence of this peptide is identical to that which is found in the first extracellular domain of OB-cadherin.

Example 3
Disruption of Endothelial Cell Adhesion Using Peptide Modulating Agents With a Cadherin-5 CAR Sequence This Example illustrates the ability of a representative linear peptide comprising a cadherin-5 CAR sequence to disrupt endothelial cell adhesion.

Human umbilical vein endothelial cells were cultured using standard procedures (see Ichikawa et al., *Amer. J. Physiol.* 273 (*Gastrointest. Liver Physiol.* 36):3642–6347, 1997). Cells were maintained in EGM (Clonetics, San Diego, Calif.) and used at P2 for all experiments. Endothelial identity was established by Dil-LDL and factor VIII staining.

The cells were cultured on glass coverslips. Monolayers were exposed to peptides at a concentration of 75 μg/mL for 60 minutes. The cells were then fixed with 95% ethanol for 30 minutes at 4° C., followed by acetone for one minute and left to air dry at room temperature. Primary antibody for VE-cadherin (Immunotech, Marseilles, France; 1:250) was added for one hour at 37° C. Coverslips were then washed with 0.1% milk/PBS solution three times for five minutes each. Secondary antibody (1:250), goat anti-rabbit FITC (Zymed, San Francisco, Calif.) was incubated at 37° C. for one hour. Coverslips were again washed with 0.1% milk/PBS solution three times for five minutes each. Coverslips were mounted with anti-quenching solution (1 mg/mL phenylenediamine (Sigma, St. Louis, Mo.) in 50% glycerol, 50% PBS). All photographs were taken at 400× and 1000× with exposure times of 12 seconds.

Figure 6A:
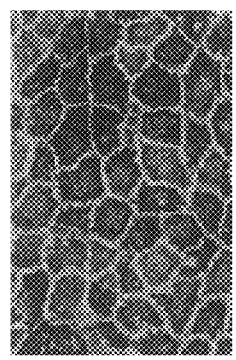
FIGS. 6A–6F are photographs showing human umbilical vein endothelial cells in the presence (FIGS. 6E and 6F) and absence (FIGS. 6A and 6B) of 75 $\mu$g/mL of a representative linear peptide modulating agent N-Ac-VFRVDAETGD-NH$_2$ (SEQ ID NO:64).
Figure 6B:
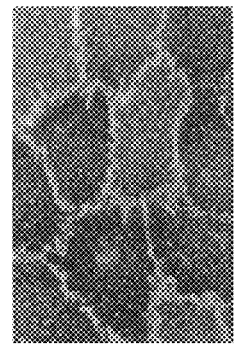
Figure 6C:
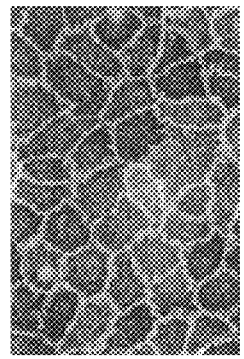
Figure 6D:
Figure 6E:
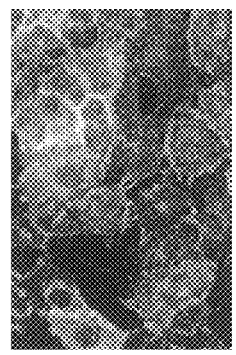
Figure 6F:
Figure 7A:
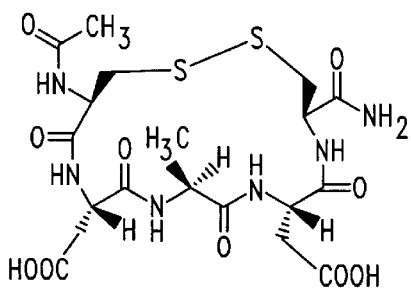
FIGS. 7A–7F provide further structures of representative modulating agents (SEQ ID NOS: 736, 823, 910, 983, 1050, 1064, 1079, 1303, 1373, 1388, 1589, 1649, 1736, 1797, 1884, 1945, 1958, 2092, 2153, 2240, 2300, 2333, 2629, 2716, 2746, 2731, 3066, 3081, 3096, 3327, 3342, 3572, 3587, 3602, 3617, 3633, 3648, 3663, 4039, 1045).
Figure 7A:
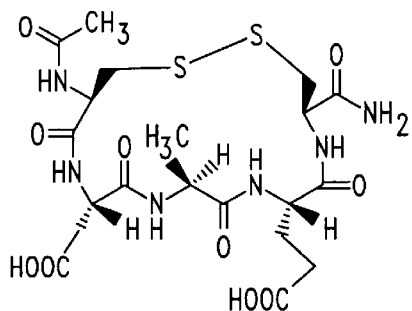
Figure 7A:
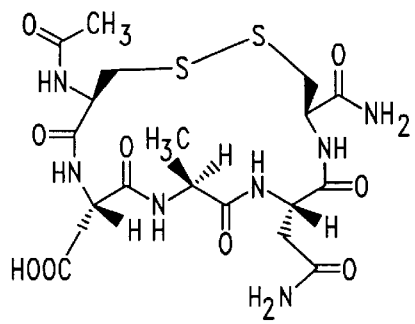
Figure 7A:
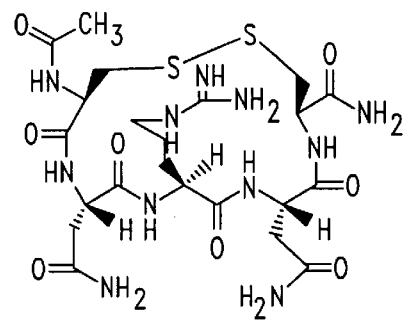
Figure 7A:
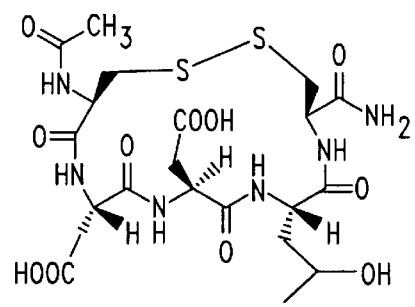
Figure 7A:
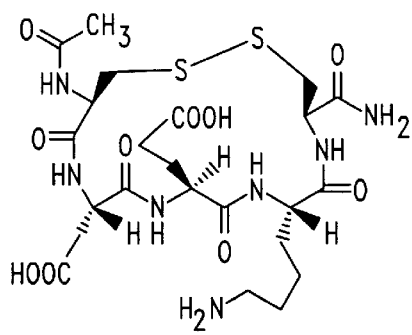
Figure 7B:
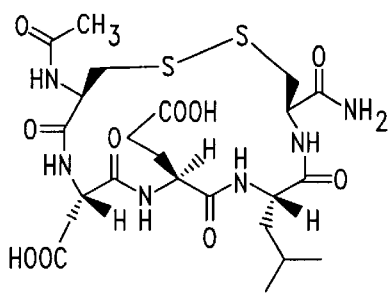
Figure 7B:
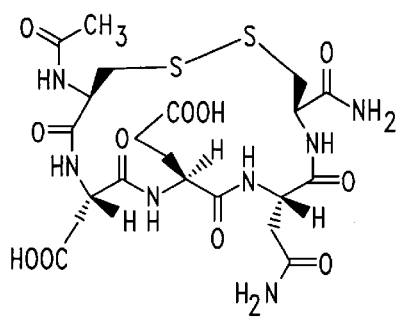
Figure 7B:
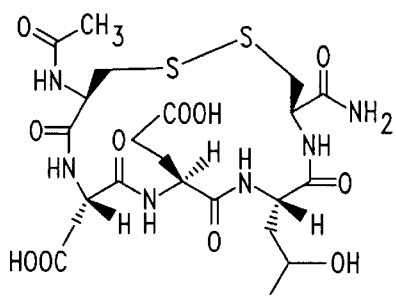
Figure 7B:
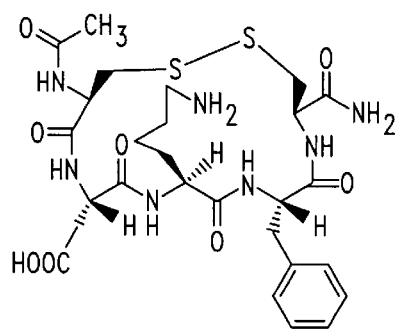
Figure 7B:
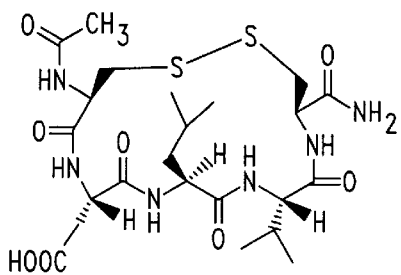
Figure 7B:
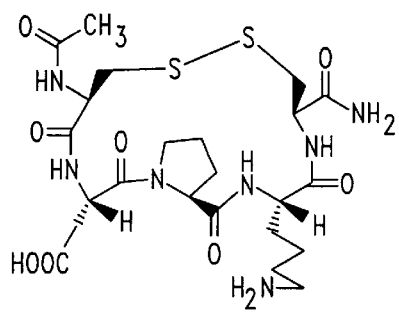
Figure 7C:
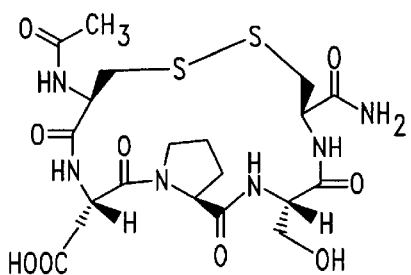
Figure 7C:
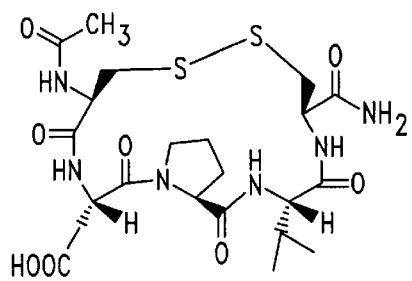
Figure 7C:
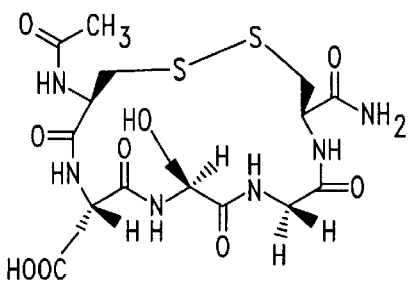
Figure 7C:
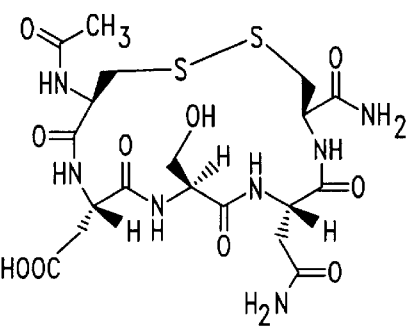
Figure 7C:
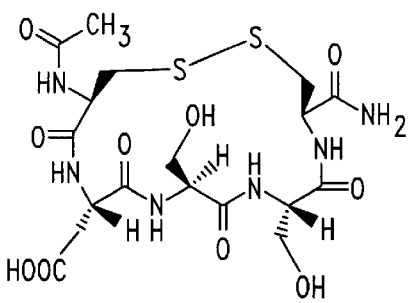
Figure 7C:
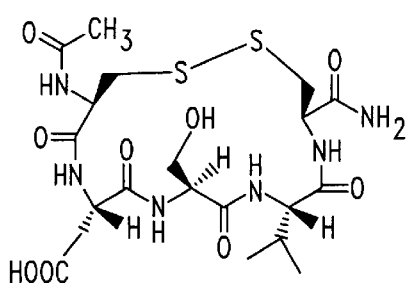
Figure 7D:
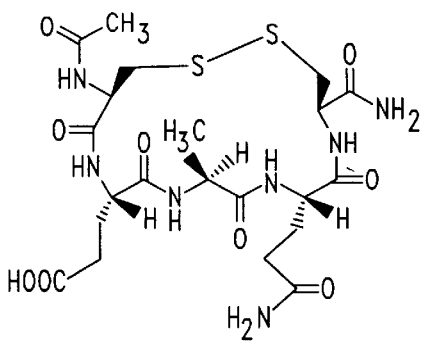
Figure 7D:
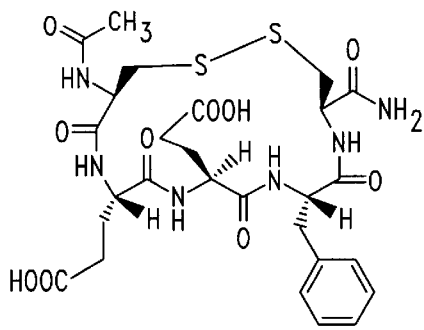
Figure 7D:
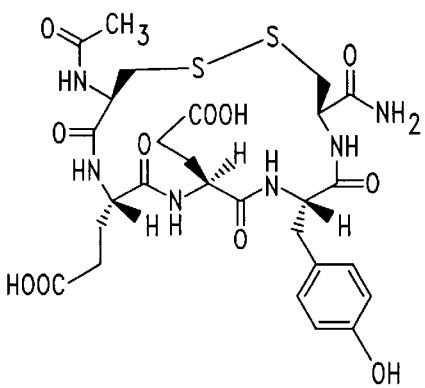
Figure 7D:
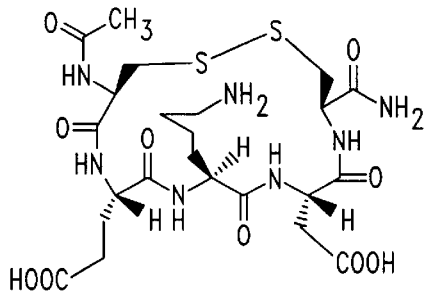
Figure 7D:
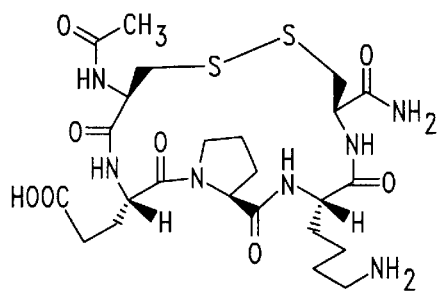
Figure 7D:
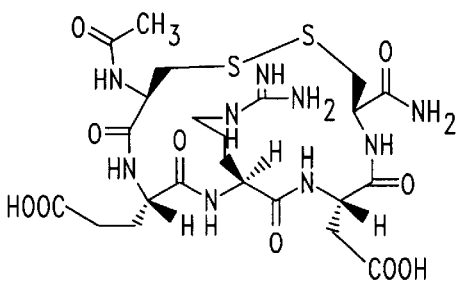
Figure 7E:
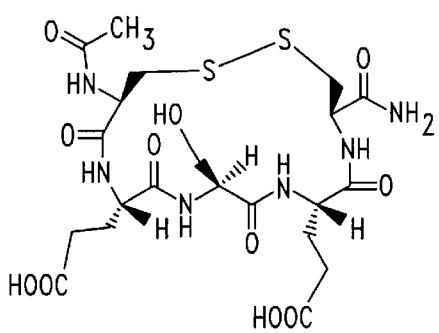
Figure 7E:
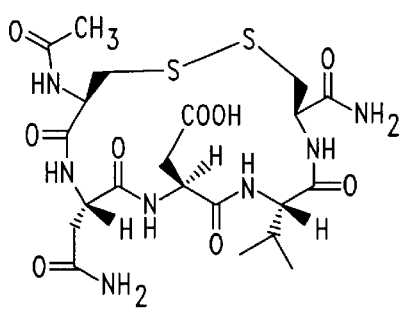
Figure 7E:
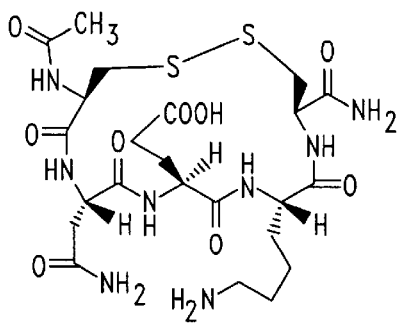
Figure 7E:
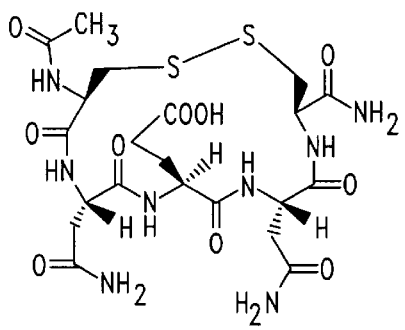
Figure 7E:
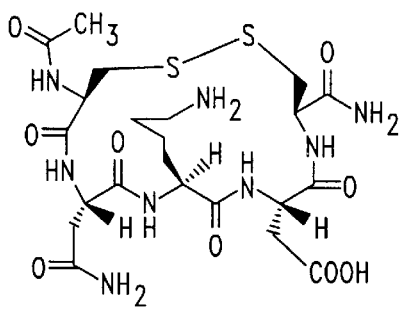
Figure 7E:
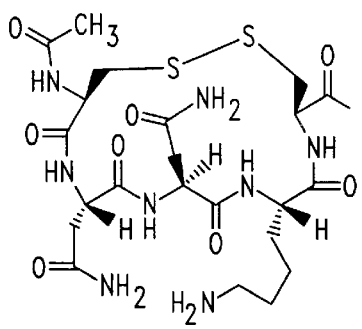
Figure 7F:
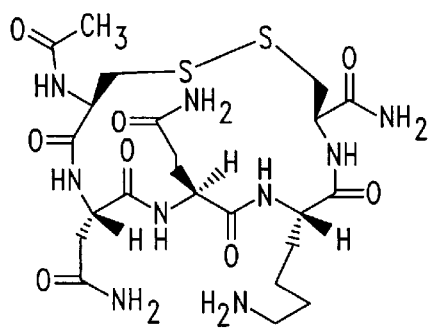
Figure 7F:
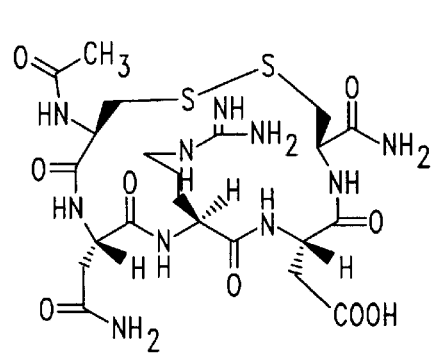

The resulting photographs are presented in FIGS. 6A–6F. FIGS. 6A and 6B are control cells. The cells in FIGS. 6C and 6D were exposed to 75 μg/mL of H-VFRVDAETGD-OH (SEQ ID NO:64) and the cells in FIGS. 6E and 6F were exposed to 75 μg/mL of the linear peptide modulating agent N-Ac-VFRVDAETGD-NH$_2$ (SEQ ID NO:64). These results indicate that the linear peptide modulating agent N-Ac-VFRVDAETGD-NH$_2$ (SEQ ID NO:64) disrupts endothelial cell adhesion, with an activity that is substantially greater that that of a similar peptide without the N- and C-terminal functional groups.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (4052 sequences)

SEQ ID NO: 1 - protein, 5 aa, Unknown
  MOD_RES (2): Where Xaa is any amino acid
  Description of Unknown Organism:  Calcium Binding Motif in Extracellular domains of Classical Cadherins
DXNDN

SEQ ID NO: 2 - protein, 4 aa, Unknown
  Description of Unknown Organism:  Calcium Binding Motif in Extracellular domains of Classical Cadherins
LDRE

SEQ ID NO: 3 - protein, 9 aa, Unknown
  MOD_RES (1): Residue is an independently selected amino acid
  MOD_RES (3): Residue is an independently selected amino acid
  MOD_RES (4): Where Xaa is Isoleucine, Leucine or Valine
  MOD_RES (5): Where Xaa is Aspartic Acid, Asparagine or Glutamic Acid
  MOD_RES (6): Residue is an independently selected amino acid
  MOD_RES (7): Residue is an independently selected amino acid
  MOD_RES (8): Where Xaa is Serine, Threonine or Asparagine
  Description of Unknown Organism:  Cell Adhesion Recognition Sequence of Nonclassical Cadherins
XFXXXXXXG

SEQ ID NO: 4 - protein, 110 aa, Homo sapiens
RSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEF

SEQ ID NO: 5 - protein, 109 aa, Homo sapiens
LHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKF

SEQ ID NO: 6 - protein, 108 aa, Homo sapiens
RQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVF

SEQ ID NO: 7 - protein, 110 aa, Homo sapiens
RSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIF

SEQ ID NO: 8 - protein, 109 aa, Homo sapiens
TKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRF

SEQ ID NO: 9 - protein, 105 aa, Homo sapiens
SKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEF

SEQ ID NO: 10 - protein, 110 aa, Gallus gallus
RTKRSWVWNQFFVLEEYMGSDPLYVGKLHSDVDKGDGSIKYILSGEGASSIFIIDENTGDIHATKRLDREEQAYYTLRAQAHDRLTNKPVEPESEFVIKIQDINDNEPKF

SEQ ID NO: 11 - protein, 109 aa, Gallus gallus
LDGPYTAGVPEMSPVGTSVVQVTATDADDPTYGNSARVVYSILQGQPYFSVEPKTGIIKTALPNMDREAKDQYLLVIQAKDMVGQNGGLSGTTSVTVTLTDVNDNPPRF

SEQ ID NO: 12 - protein, 105 aa, Gallus gallus
TSRLYSMVVSEAAKVGTIIGTVAAHDPDASNSPVRYSIDRNTDLERYFNIDANSGVITTAKSLDRETNAVHNITVLAMESQNPAQIGRGYVAITILDINDNAPEF

SEQ ID NO: 13 - protein, 110 aa, Homo sapiens
RSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEF

SEQ ID NO: 14 - protein, 110 aa, Homo sapiens
RVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKF

SEQ ID NO: 15 - protein, 109 aa, Homo sapiens
LDGPYVATVPEMSPVGAYVLQVKATDADDPTYGNSARVVYSILQGQPYFSIDPKTGVIRTALPNMDREVKEQYQVLIQAKDMGGQLGGLAGTTIVNITLTDVNDNPPRF

SEQ ID NO: 16 - protein, 110 aa, Homo sapiens
RPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKF

SEQ ID NO: 17 - protein, 109 aa, Homo sapiens
TDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRF

SEQ ID NO: 18 - protein, 105 aa, Homo sapiens
SMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPEL

SEQ ID NO: 19 - protein, 111 aa, Homo sapiens
RVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDLEIVVVDQNDNRPAF

SEQ ID NO: 20 - protein, 108 aa, Homo sapiens
LQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEF

SEQ ID NO: 21 - protein, 111 aa, Homo sapiens
RQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIF

SEQ ID NO: 22 - protein, 110 aa, Rattus norvegicus
RVKRGWVWNQFFVVEEYTGTEPLYVGKIHSDSDEGDGTIKYTISGEGAGTIFLIDELTGDIHATERLDREQKTFYTLRAQARDRATNRLLEPESEFIIKVQDINDSEPRF

SEQ ID NO: 23 - protein, 109 aa, Rattus norvegicus
LHGPYIGSVAELSPTGTSVMQVMASDADDPTYGSSARLVYSVLDGEHHFTVDPKTGVIRTAVPDLDRESQERYEVVIQATDMAGQLGGLSGSTTVTIVVTDVNDNPPRF

SEQ ID NO: 24 - protein, 105 aa, Rattus norvegicus
RPPSGLLEVQEDAQVGSLVGVVTARDPDAANRPVRYAIDRDSDLEQIFDIDADTGAIVTGKGLDRETAGWHNITVLAMEADNHAQLSRASLRIRILDVNDNPPEL

SEQ ID NO: 25 - protein, 117 aa, Homo sapiens
LQSKYEGSVRQNSRPGKPFLYVNATDLDDPATPNGQLYYQIVIQLPMINNVMYFQINNKTGAISLTREGSQELNPAKNPYNLVISVKDMGGQSENSFSDTTSVDIIVTENIWKAPAP

SEQ ID NO: 26 - protein, 108 aa, Homo sapiens
NQSLYRARVPGGCTSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEI

SEQ ID NO: 27 - protein, 110 aa, Homo sapiens
SQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQV

SEQ ID NO: 28 - protein, 108 aa, Homo sapiens
EAPSYLVELPENTPLGTVVIDLNATDADEGPNGEVLYSFSSYVPDRVRELFSIDPKTGLIRVKGNLDYEENGMLEIDVQARDLGPNLIPAHCKVTVKLIDRNDNAPSI

SEQ ID NO: 29 - protein, 89 aa, Homo sapiens
VLPTLQNDTAELQVPRNAGLGYLVSTVRALDSDFGESGRLTYEIVDGNDDHLFEIDPSSGEIRTLHPFWEDVTPVVELVVKVTDHGKPT

SEQ ID NO: 30 - protein, 112 aa, Homo sapiens
RQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVF

SEQ ID NO: 31 - protein, 112 aa, Homo sapiens
SMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYM

SEQ ID NO: 32 - protein, 113 aa, Homo sapiens
TQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVV

SEQ ID NO: 33 - protein, 107 aa, Homo sapiens
RWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPY

SEQ ID NO: 34 - protein, 107 aa, Homo sapiens
RWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPI

SEQ ID NO: 35 - protein, 107 aa, Homo sapiens
RWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPV

SEQ ID NO: 36 - protein, 107 aa, Homo sapiens; identical to SEQ ID NO: 35

SEQ ID NO: 37 - protein, 108 aa, Mus musculus
DRSLYTVKLPENVPNGTLVVKVNASDLDEGVNGDIMYSFSTDISPNVKYKFHIDPVSGEIIVKGYIDFEECKSYEILIEGIDKGQLPLSGHCKVIVQVEDINDNVPEL

SEQ ID NO: 38 - protein, 108 aa, Mus musculus
QHPEYEVRILENSDNGTTVIRLNASDKDEGTNSAISYSFNRLVPPKTLEQFSIDADTGEIITQGNLDFEQVDVYKIHVDATDKGHPPMVGHCTVLVKVLDENDNVPQI

SEQ ID NO: 39 - protein, 108 aa, Mus musculus
DRAIYRVKLVENARNGTVVIRLNASDLDEGSNGQILYSFAADVSPKTEATFHIDSVSGEIKVNGKIDFEETNLWKIQAEAVDKGSPPMFGHCTILIEVLDINDNAPKI

SEQ ID NO: 40 - protein, 108 aa, Mus musculus
DRFVYKVKVLEDALNGTLVINLNATDPDEGINGDIIYSFRRPVSPAVVHAFNIDSNSGEVRTKGLLDFEEIKLYEIPVEAVDKGNIPMTGHCTLLVELLDVNDNAPEV

SEQ ID NO: 41 - protein, 108 aa, Mus musculus
DKSIYNVRLLENTPNGTLVIKLNASDADEGINKEILYFFSNLVLDDVKSKFTIDSSSGEIKVKGELDYEDCKVYEINIDAVDRSAFPLAGHCKIIVKLVDVNDNVPEM

SEQ ID NO: 42 - protein, 107 aa, Mus musculus
DHLEYKVRIMENAAKETLVITLNATDLDEGANGQLVYSLMSIKPTGRHLFTLDEKNGELRVNGTLDYEENKLYEIEVLATDKGTPPMVGHCVVLVEILDTNDNSPEV

SEQ ID NO: 43 - protein, 108 aa, Mus musculus
DRSVYEVKMYENQENKTLVIWLNATDSDEGINKEVEYSFSSLASSIIRQKFLINEKTGEIKINGAIDFEESNNYEIHVDATDKGYPPMVAHCTVLVEILDENDNAPEI

SEQ ID NO: 44 - protein, 106 aa, Homo sapiens
GWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEF

SEQ ID NO: 45 - protein, 106 aa, Mus musculus; identical to SEQ ID NO: 44

SEQ ID NO: 46 - protein, 4 aa, Unknown
  Description of Unknown Organism:  Calcium Binding Motifs in the Extracellular Domains of Nonclassical Cadherins
XDXE

SEQ ID NO: 47 - protein, 5 aa, Unknown
  Description of Unknown Organism:  Calcium Binding Motifs in the Extracellular Domains of Nonclassical Cadherins
DXXDX

SEQ ID NO: 48 - protein, 5 aa, Unknown
  Description of Unknown Organism:  Clasical Cadherin Cell Adhesion Recognition Sequence
YIGSR

SEQ ID NO: 49 - protein, 10 aa, Unknown
  Description of Unknown Organism:  Clasical Cadherin Cell Adhesion Recognition Sequence
KYSFNYDGSE

SEQ ID NO: 50 - protein, 17 aa, Unknown
  Description of Unknown Organism:  N-CAM Heparin Sulfate-Binding Site
IWKHKGRDVILKKDVRF

SEQ ID NO: 51 - protein, 4 aa, Unknown
  Description of Unknown Organism:  Putative Claudin Cell Adhesion Recognition Sequence
IYSY

SEQ ID NO: 52 - protein, 4 aa, Unknown
  Description of Unknown Organism:  Occludin Cell Adhesion Recognition Sequence
LYHY

SEQ ID NO: 53 - protein, 10 aa, Artificial Sequence
  Cyclic Peptide
  MOD_RES (2): Where Xaa is beta,beta-tetramethylene cysteine
  Description of Artificial Sequence:  Product of Synthesis and Cyclization based on Human OB-Cadherin
IXVIDDKSCE

SEQ ID NO: 54 - protein, 10 aa, Artificial Sequence
  Description of Artificial Sequence:  Product of Synthesis and Cyclization based on Human OB-Cadherin
  Cyclic Peptide
  MOD_RES (2): Where Xaa is beta,beta-pentamethylene cysteine
IXVIDDKSGC

SEQ ID NO: 55 - protein, 9 aa, Artificial Sequence
  Description of Artificial Sequence:  Product of Synthesis and Cyclization based on Human OB-Cadherin
  Cyclic Peptide
  MOD_RES (1): Where Xaa is beta-mercaptopropionic acid
XVIDDKSGC

SEQ ID NO: 56 - protein, 9 aa, Artificial Sequence
  Description of Artificial Sequence:  Product of Synthesis and Cyclization based on Human OB-Cadherin
  Cyclic Peptide
  MOD_RES (1): Where Xaa is beta,beta-pentamethylene-beta-mercaptopropionic acid
XVIDDKSGC

SEQ ID NO: 57 - protein, 5 aa, Artificial Sequence
  Cyclic Peptide
  MOD_RES (4): Where Xaa is D-Serine
  Description of Artificial Sequence:  Product of Synthesis and Cyclization based on Human OB-Cadherin
DDKXS

SEQ ID NO: 58 - protein, 4 aa, Artificial Sequence
  Description of Artificial Sequence:  Product of Synthesis and Cyclization based on Human OB-Cadherin
  Cyclic Peptide
WGGW

SEQ ID NO: 59 - protein, 6 aa, Unknown
  Description of Unknown Organism:  E-Cadherin Cell Adhesion Recognition Sequence
SHAVSS

SEQ ID NO: 60 - protein, 6 aa, Unknown
  Description of Unknown Organism:  N-Cadherin Cell Adhesion Recognition Sequence
AHAVDI

SEQ ID NO: 61 - protein, 15 aa, Unknown
  Description of Unknown Organism:  N-Cadherin Cell Adhesion Recognition Sequence
FHLRAHAVDINGNQV

SEQ ID NO: 62 - protein, 48 aa, Unknown
  Description of Unknown Organism:  Occludin Cell Adhesion Recognition Sequence
GVNPTAQSSGSLYGSQIYALCNQFYTPAATGLYVDQYLYHYCVVDPQE

SEQ ID NO: 63 - protein, 10 aa, Unknown
  Description of Unknown Organism:  N-CAM Cell Adhesion Recognition Sequence
KYSFNYDGSE

SEQ ID NO: 64 - protein, 10 aa, Artificial Sequence
  Description of Artificial Sequence:  Product of Synthesis based on Human Cadherin-5 Cell Adhesion Recognition Sequence
VFRVDAETGD

SEQ ID NO: 65 - protein, 4 aa, Unknown
  Description of Unknown Organism:  Calcium Binding Motifs in the Extracellular Domains of Nonclassical Cadherins
MDRE

SEQ ID NO: 66 - protein, 4 aa, Unknown
  Description of Unknown Organism:  Calcium Binding Motifs in the Extracellular Domains of Nonclassical Cadherins
LDFE

SEQ ID NO: 67 - protein, 4 aa, Unknown
  Description of Unknown Organism:  Calcium Binding Motifs in the Extracellular Domains of Nonclassical Cadherins
LDYE

SEQ ID NO: 68 - protein, 4 aa, Unknown
  Description of Unknown Organism:  Calcium Binding Motifs in the Extracellular Domains of Nonclassical Cadherins
IDRE

SEQ ID NO: 69 - protein, 4 aa, Unknown
  Description of Unknown Organism:  Calcium Binding Motifs in the Extracellular Domains of Nonclassical Cadherins
VDRE

SEQ ID NO: 70 - protein, 4 aa, Unknown
  Description of Unknown Organism:  Calcium Binding Motifs in the Extracellular Domains of Nonclassical Cadherins
IDFE

SEQ ID NO: 71 - protein, 5 aa, Artificial Sequence
  MOD_RES (5): Where Xaa is beta,beta-dimethyl cysteine
  Cyclic Peptide
  Description of Artificial Sequence:  Product of Synthesis and Cyclization based on Human OB-cadherin
CDDKX

SEQ ID NO: 72 - protein, 11 aa, Unknown
  Description of Unknown Organism:  Calcium Binding Motifs in Extracellular Domains of Nonclassical Cadherins
XXXXDXNDXXP

SEQ ID NO: 73 - protein, 4 aa, Artificial Sequence
  Representative linear modulating agent based on OB-cadherin cell adhesion recognition sequence
DDKS

SEQ ID NO: 74 - protein, 5 aa, Artificial Sequence
  Representative linear modulating agent based on OB-cadherin cell adhesion recognition sequence
VIDDK

SEQ ID NO: 75 - protein, 5 aa, Artificial Sequence
  Representative linear modulating agent based on OB-cadherin cell adhesion recognition sequence
IDDKS

SEQ ID NO: 76 - protein, 6 aa, Artificial Sequence
  Representative linear modulating agent based on OB-cadherin cell adhesion recognition sequence
VIDDKS

SEQ ID NO: 77 - protein, 5 aa, Artificial Sequence
  Representative linear modulating agent based on OB-cadherin cell adhesion recognition sequence
DDKSG

SEQ ID NO: 78 - protein, 6 aa, Artificial Sequence
  Representative linear modulating agent based on OB-cadherin cell adhesion recognition sequence
IDDKSG

SEQ ID NO: 79 - protein, 7 aa, Artificial Sequence
  Representative linear modulating agent based on OB-cadherin cell adhesion recognition sequence
VIDDKSG

SEQ ID NO: 80 - protein, 6 aa, Artificial Sequence
  Representative linear modulating agent based on OB-cadherin cell adhesion recognition sequence
FVIDDK

SEQ ID NO: 81 - protein, 7 aa, Artificial Sequence
  Representative linear modulating agent based on OB-cadherin cell adhesion recognition sequence
FVIDDKS

SEQ ID NO: 82 - protein, 8 aa, Artificial Sequence
  Representative linear modulating agent based on OB-cadherin cell adhesion recognition sequence
FVIDDKSG

SEQ ID NO: 83 - protein, 7 aa, Artificial Sequence
  Representative linear modulating agent based on OB-cadherin cell adhesion recognition sequence
IFVIDDK

SEQ ID NO: 84 - protein, 8 aa, Artificial Sequence
  Representative linear modulating agent based on OB-cadherin cell adhesion recognition sequence
IFVIDDKS

SEQ ID NO: 85 - protein, 9 aa, Artificial Sequence
  Representative linear modulating agent based on OB-cadherin cell adhesion recognition sequence
IFVIDDKSG

SEQ ID NO: 86 - protein, 4 aa, Artificial Sequence
  Representative linear modulating agent based on OB-cadherin cell adhesion recognition sequence
IEEY

SEQ ID NO: 87 - protein, 4 aa, Artificial Sequence
  Representative linear modulating agent based on OB-cadherin cell adhesion recognition sequence
EEYT

SEQ ID NO: 88 - protein, 5 aa, Artificial Sequence
  Representative linear modulating agent based on OB-cadherin cell adhesion recognition sequence
VIEEY

SEQ ID NO: 89 - protein, 5 aa, Artificial Sequence
  Representative linear modulating agent based on OB-cadherin cell adhesion recognition sequence
IEEYT

SEQ ID NO: 90 - protein, 6 aa, Artificial Sequence
  Representative linear modulating agent based on OB-cadherin cell adhesion recognition sequence
VIEEYT

SEQ ID NO: 91 - protein, 5 aa, Artificial Sequence
  Representative linear modulating agent based on OB-cadherin cell adhesion recognition sequence
EEYTG

SEQ ID NO: 92 - protein, 6 aa, Artificial Sequence
  Representative linear modulating agent based on OB-cadherin cell adhesion recognition sequence
IEEYTG

SEQ ID NO: 93 - protein, 7 aa, Artificial Sequence
  Representative linear modulating agent based on OB-cadherin cell adhesion recognition sequence
VIEEYTG

SEQ ID NO: 94 - protein, 6 aa, Artificial Sequence
  Representative linear modulating agent based on OB-cadherin cell adhesion recognition sequence
FVIEEY

SEQ ID NO: 95 - protein, 7 aa, Artificial Sequence
  Representative linear modulating agent based on OB-cadherin cell adhesion recognition sequence
FVIEEYT

SEQ ID NO: 96 - protein, 8 aa, Artificial Sequence
  Representative linear modulating agent based on OB-cadherin cell adhesion recognition sequence
FVIEEYTG

SEQ ID NO: 97 - protein, 7 aa, Artificial Sequence
  Representative linear modulating agent based on OB-cadherin cell adhesion recognition sequence
FFVIEEY

SEQ ID NO: 98 - protein, 8 aa, Artificial Sequence
  Representative linear modulating agent based on OB-cadherin cell adhesion recognition sequence
FFVIEEYT

SEQ ID NO: 99 - protein, 9 aa, Artificial Sequence
  Representative linear modulating agent based on OB-cadherin cell adhesion recognition sequence
FFVIEEYTG

SEQ ID NO: 100 - protein, 4 aa, Artificial Sequence
  Representative linear modulating agent based on OB-cadherin cell adhesion recognition sequence
VEAQ

SEQ ID NO: 101 - protein, 4 aa, Artificial Sequence
  Representative linear modulating agent based on OB-cadherin cell adhesion recognition sequence
EAQT

SEQ ID NO: 102 - protein, 5 aa, Artificial Sequence
  Representative linear modulating agent based on OB-cadherin cell adhesion recognition sequence
SVEAQ

SEQ ID NO: 103 - protein, 5 aa, Artificial Sequence
  Representative linear modulating agent based on OB-cadherin cell adhesion recognition sequence
VEAQT

SEQ ID NO: 104 - protein, 6 aa, Artificial Sequence
  Representative linear modulating agent based on OB-cadherin cell adhesion recognition sequence
SVEAQT

SEQ ID NO: 105 - protein, 5 aa, Artificial Sequence
  Representative linear modulating agent based on OB-cadherin cell adhesion recognition sequence
EAQTG

SEQ ID NO: 106 - protein, 6 aa, Artificial Sequence
  Representative linear modulating agent based on OB-cadherin cell adhesion recognition sequence
VEAQTG

SEQ ID NO: 107 - protein, 7 aa, Artificial Sequence
  Representative linear modulating agent based on OB-cadherin cell adhesion recognition sequence
SVEAQTG

SEQ ID NO: 108 - protein, 6 aa, Artificial Sequence
  Representative linear modulating agent based on OB-cadherin cell adhesion recognition sequence
FSVEAQ

SEQ ID NO: 109 - protein, 7 aa, Artificial Sequence
  Representative linear modulating agent based on OB-cadherin cell adhesion recognition sequence
FSVEAQT

SEQ ID NO: 110 - protein, 8 aa, Artificial Sequence
  Representative linear modulating agent based on OB-cadherin cell adhesion recognition sequence
FSVEAQTG

SEQ ID NO: 111 - protein, 7 aa, Artificial Sequence
  Representative linear modulating agent based on OB-cadherin cell adhesion recognition sequence
YFSVEAQ

SEQ ID NO: 112 - protein, 8 aa, Artificial Sequence
  Representative linear modulating agent based on OB-cadherin cell adhesion recognition sequence
YFSVEAQT

SEQ ID NO: 113 - protein, 9 aa, Artificial Sequence
  Representative linear modulating agent based on OB-cadherin cell adhesion recognition sequence
YFSVEAQTG

SEQ ID NO: 114 - protein, 4 aa, Artificial Sequence
  Representative linear modulating agent based on cadherin-5 cell adhesion recognition sequence
VDAE

SEQ ID NO: 115 - protein, 4 aa, Artificial Sequence
  Representative linear modulating agent based on cadherin-5 cell adhesion recognition sequence
DAET

SEQ ID NO: 116 - protein, 5 aa, Artificial Sequence
  Representative linear modulating agent based on cadherin-5 cell adhesion recognition sequence
RVDAE

SEQ ID NO: 117 - protein, 5 aa, Artificial Sequence
  Representative linear modulating agent based on cadherin-5 cell adhesion recognition sequence
VDAET

SEQ ID NO: 118 - protein, 6 aa, Artificial Sequence
  Representative linear modulating agent based on cadherin-5 cell adhesion recognition sequence
RVDAET

SEQ ID NO: 119 - protein, 5 aa, Artificial Sequence
  Representative linear modulating agent based on cadherin-5 cell adhesion recognition sequence
DAETG

SEQ ID NO: 120 - protein, 6 aa, Artificial Sequence
  Representative linear modulating agent based on cadherin-5 cell adhesion recognition sequence
VDAETG

SEQ ID NO: 121 - protein, 7 aa, Artificial Sequence
  Representative linear modulating agent based on cadherin-5 cell adhesion recognition sequence
RVDAETG

SEQ ID NO: 122 - protein, 6 aa, Artificial Sequence
  Representative linear modulating agent based on cadherin-5 cell adhesion recognition sequence
FRVDAE

SEQ ID NO: 123 - protein, 7 aa, Artificial Sequence
  Representative linear modulating agent based on cadherin-5 cell adhesion recognition sequence
FRVDAET

SEQ ID NO: 124 - protein, 8 aa, Artificial Sequence
  Representative linear modulating agent based on cadherin-5 cell adhesion recognition sequence
FRVDAETG

SEQ ID NO: 125 - protein, 7 aa, Artificial Sequence
  Representative linear modulating agent based on cadherin-5 cell adhesion recognition sequence
VFRVDAE

SEQ ID NO: 126 - protein, 8 aa, Artificial Sequence
  Representative linear modulating agent based on cadherin-5 cell adhesion recognition sequence
VFRVDAET

SEQ ID NO: 127 - protein, 9 aa, Artificial Sequence
  Representative linear modulating agent based on cadherin-5 cell adhesion recognition sequence
VFRVDAETG

SEQ ID NO: 128 - protein, 4 aa, Artificial Sequence
  Representative linear modulating agent based on cadherin-6 cell adhesion recognition sequence
INEN

SEQ ID NO: 129 - protein, 4 aa, Artificial Sequence
  Representative linear modulating agent based on cadherin-6 cell adhesion recognition sequence
NENT

SEQ ID NO: 130 - protein, 5 aa, Artificial Sequence
  Representative linear modulating agent based on cadherin-6 cell adhesion recognition sequence
IINEN

SEQ ID NO: 131 - protein, 5 aa, Artificial Sequence
  Representative linear modulating agent based on cadherin-6 cell adhesion recognition sequence
INENT

SEQ ID NO: 132 - protein, 6 aa, Artificial Sequence
  Representative linear modulating agent based on cadherin-6 cell adhesion recognition sequence
IINENT

SEQ ID NO: 133 - protein, 5 aa, Artificial Sequence
  Representative linear modulating agent based on cadherin-6 cell adhesion recognition sequence
NENTG

SEQ ID NO: 134 - protein, 6 aa, Artificial Sequence
  Representative linear modulating agent based on cadherin-6 cell adhesion recognition sequence
INENTG

SEQ ID NO: 135 - protein, 7 aa, Artificial Sequence
  Representative linear modulating agent based on cadherin-6 cell adhesion recognition sequence
IINENTG

SEQ ID NO: 136 - protein, 6 aa, Artificial Sequence
  Representative linear modulating agent based on cadherin-6 cell adhesion recognition sequence
FIINEN

SEQ ID NO: 137 - protein, 7 aa, Artificial Sequence
  Representative linear modulating agent based on cadherin-6 cell adhesion recognition sequence
FIINENT

SEQ ID NO: 138 - protein, 8 aa, Artificial Sequence
  Representative linear modulating agent based on cadherin-6 cell adhesion recognition sequence
FIINENTG

SEQ ID NO: 139 - protein, 7 aa, Artificial Sequence
  Representative linear modulating agent based on cadherin-6 cell adhesion recognition sequence
LFIINEN

SEQ ID NO: 140 - protein, 8 aa, Artificial Sequence
  Representative linear modulating agent based on cadherin-6 cell adhesion recognition sequence
LFIINENT

SEQ ID NO: 141 - protein, 9 aa, Artificial Sequence
  Representative linear modulating agent based on cadherin-6 cell adhesion recognition sequence
LFIINENTG

SEQ ID NO: 142 - protein, 4 aa, Artificial Sequence
  Representative linear modulating agent based on cadherin-6 cell adhesion recognition sequence
EEYT

SEQ ID NO: 143 - protein, 5 aa, Artificial Sequence
  Representative linear modulating agent based on cadherin-6 cell adhesion recognition sequence
EEYTG

SEQ ID NO: 144 - protein, 4 aa, Artificial Sequence
  Representative linear modulating agent based on cadherin-6 cell adhesion recognition sequence
LEEY

SEQ ID NO: 145 - protein, 5 aa, Artificial Sequence
  Representative linear modulating agent based on cadherin-6 cell adhesion recognition sequence
LEEYT

SEQ ID NO: 146 - protein, 6 aa, Artificial Sequence
  Representative linear modulating agent based on cadherin-6 cell adhesion recognition sequence
LEEYTG

SEQ ID NO: 147 - protein, 5 aa, Artificial Sequence
  Representative linear modulating agent based on cadherin-6 cell adhesion recognition sequence
LLEEY

SEQ ID NO: 148 - protein, 7 aa, Artificial Sequence
  Representative linear modulating agent based on cadherin-6 cell adhesion recognition sequence
LLEEYTG

SEQ ID NO: 149 - protein, 6 aa, Artificial Sequence
  Representative linear modulating agent based on cadherin-6 cell adhesion recognition sequence
FLLEEY

SEQ ID NO: 150 - protein, 7 aa, Artificial Sequence
  Representative linear modulating agent based on cadherin-6 cell adhesion recognition sequence
FLLEEYT

SEQ ID NO: 151 - protein, 8 aa, Artificial Sequence
  Representative linear modulating agent based on cadherin-6 cell adhesion recognition sequence
FLLEEYTG

SEQ ID NO: 152 - protein, 7 aa, Artificial Sequence
  Representative linear modulating agent based on cadherin-6 cell adhesion recognition sequence
FFLLEEY

SEQ ID NO: 153 - protein, 8 aa, Artificial Sequence
  Representative linear modulating agent based on cadherin-6 cell adhesion recognition sequence
FFLLEEYT

SEQ ID NO: 154 - protein, 9 aa, Artificial Sequence
  Representative linear modulating agent based on cadherin-6 cell adhesion recognition sequence
FFLLEEYTG

SEQ ID NO: 155 - protein, 4 aa, Artificial Sequence
  Representative linear modulating agent based on cadherin-6 cell adhesion recognition sequence
ESET

SEQ ID NO: 156 - protein, 5 aa, Artificial Sequence
  Representative linear modulating agent based on cadherin-6 cell adhesion recognition sequence
ESETG

SEQ ID NO: 157 - protein, 4 aa, Artificial Sequence
  Representative linear modulating agent based on cadherin-6 cell adhesion recognition sequence
VESE

SEQ ID NO: 158 - protein, 5 aa, Artificial Sequence
  Representative linear modulating agent based on cadherin-6 cell adhesion recognition sequence
VSEST

SEQ ID NO: 159 - protein, 6 aa, Artificial Sequence
  Representative linear modulating agent based on cadherin-6 cell adhesion recognition sequence
VESETG

SEQ ID NO: 160 - protein, 5 aa, Artificial Sequence
  Representative linear modulating agent based on cadherin-6 cell adhesion recognition sequence
SVESE

SEQ ID NO: 161 - protein, 6 aa, Artificial Sequence
  Representative linear modulating agent based on cadherin-6 cell adhesion recognition sequence
SVESET

SEQ ID NO: 162 - protein, 7 aa, Artificial Sequence
  Representative linear modulating agent based on cadherin-6 cell adhesion recognition sequence
SVESETG

SEQ ID NO: 163 - protein, 6 aa, Artificial Sequence
  Representative linear modulating agent based on cadherin-6 cell adhesion recognition sequence
FSVESE

SEQ ID NO: 164 - protein, 7 aa, Artificial Sequence
  Representative linear modulating agent based on cadherin-6 cell adhesion recognition sequence
FSVESET

SEQ ID NO: 165 - protein, 8 aa, Artificial Sequence
  Representative linear modulating agent based on cadherin-6 cell adhesion recognition sequence
FSVESETG

SEQ ID NO: 166 - protein, 7 aa, Artificial Sequence
  Representative linear modulating agent based on cadherin-6 cell adhesion recognition sequence
YFSVESE

SEQ ID NO: 167 - protein, 8 aa, Artificial Sequence
  Representative linear modulating agent based on cadherin-6 cell adhesion recognition sequence
YFSVESET

SEQ ID NO: 168 - protein, 9 aa, Artificial Sequence
  Representative linear modulating agent based on cadherin-6 cell adhesion recognition sequence
YFSVESETG

SEQ ID NO: 169 - protein, 4 aa, Artificial Sequence
  Representative linear modulating agent based on cadherin-6 cell adhesion recognition sequence
DSGN

SEQ ID NO: 170 - protein, 5 aa, Artificial Sequence
  Representative linear modulating agent based on cadherin-6 cell adhesion recognition sequence
DSGNG

SEQ ID NO: 171 - protein, 4 aa, Artificial Sequence
  Representative linear modulating agent based on cadherin-6 cell adhesion recognition sequence
IDSG

SEQ ID NO: 172 - protein, 5 aa, Artificial Sequence
  Representative linear modulating agent based on cadherin-6 cell adhesion recognition sequence
IDSGN

SEQ ID NO: 173 - protein, 6 aa, Artificial Sequence
  Representative linear modulating agent based on cadherin-6 cell adhesion recognition sequence
IDSGNG

SEQ ID NO: 174 - protein, 5 aa, Artificial Sequence
  Representative linear modulating agent based on cadherin-6 cell adhesion recognition sequence
NIDSG

SEQ ID NO: 175 - protein, 6 aa, Artificial Sequence
  Representative linear modulating agent based on cadherin-6 cell adhesion recognition sequence
NIDSGN

SEQ ID NO: 176 - protein, 7 aa, Artificial Sequence
  Representative linear modulating agent based on cadherin-6 cell adhesion recognition sequence
NIDSGNG

SEQ ID NO: 177 - protein, 6 aa, Artificial Sequence
  Representative linear modulating agent based on cadherin-6 cell adhesion recognition sequence
FNIDSG

SEQ ID NO: 178 - protein, 7 aa, Artificial Sequence
  Representative linear modulating agent based on cadherin-6 cell adhesion recognition sequence
FNIDSGN

SEQ ID NO: 179 - protein, 8 aa, Artificial Sequence
  Representative linear modulating agent based on cadherin-6 cell adhesion recognition sequence
FNIDSGNG

SEQ ID NO: 180 - protein, 7 aa, Artificial Sequence
  Representative linear modulating agent based on cadherin-6 cell adhesion recognition sequence
IFNIDSG

SEQ ID NO: 181 - protein, 8 aa, Artificial Sequence
  Representative linear modulating agent based on cadherin-6 cell adhesion recognition sequence
IFNIDSGN

SEQ ID NO: 182 - protein, 9 aa, Artificial Sequence
  Representative linear modulating agent based on cadherin-6 cell adhesion recognition sequence
IFNIDSGNG

SEQ ID NO: 183 - protein, 4 aa, Artificial Sequence
  Representative linear modulating agent based on cadherin-7 cell adhesion recognition sequence
IDEN

SEQ ID NO: 184 - protein, 4 aa, Artificial Sequence
  Representative linear modulating agent based on cadherin-7 cell adhesion recognition sequence
DENT

SEQ ID NO: 185 - protein, 5 aa, Artificial Sequence
  Representative linear modulating agent based on cadherin-7 cell adhesion recognition sequence
IIDEN

SEQ ID NO: 186 - protein, 5 aa, Artificial Sequence
  Representative linear modulating agent based on cadherin-7 cell adhesion recognition sequence
IDENT

SEQ ID NO: 187 - protein, 6 aa, Artificial Sequence
  Representative linear modulating agent based on cadherin-7 cell adhesion recognition sequence
IIDENT

SEQ ID NO: 188 - protein, 5 aa, Artificial Sequence
  Representative linear modulating agent based on cadherin-7 cell adhesion recognition sequence
DENTG

SEQ ID NO: 189 - protein, 6 aa, Artificial Sequence
  Representative linear modulating agent based on cadherin-7 cell adhesion recognition sequence
IDENTG

SEQ ID NO: 190 - protein, 7 aa, Artificial Sequence
  Representative linear modulating agent based on cadherin-7 cell adhesion recognition sequence
IIDENTG

SEQ ID NO: 191 - protein, 6 aa, Artificial Sequence
  Representative linear modulating agent based on cadherin-7 cell adhesion recognition sequence
FIIDEN

SEQ ID NO: 192 - protein, 7 aa, Artificial Sequence
  Representative linear modulating agent based on cadherin-7 cell adhesion recognition sequence
FIIDENT

SEQ ID NO: 193 - protein, 8 aa, Artificial Sequence
  Representative linear modulating agent based on cadherin-7 cell adhesion recognition sequence
FIIDENTG

SEQ ID NO: 194 - protein, 7 aa, Artificial Sequence
  Representative linear modulating agent based on cadherin-7 cell adhesion recognition sequence
IFIIDEN

SEQ ID NO: 195 - protein, 8 aa, Artificial Sequence
  Representative linear modulating agent based on cadherin-7 cell adhesion recognition sequence
IFIIDENT

SEQ ID NO: 196 - protein, 9 aa, Artificial Sequence
  Representative linear modulating agent based on cadherin-7 cell adhesion recognition sequence
IFIIDENTG

SEQ ID NO: 197 - protein, 4 aa, Artificial Sequence
  Representative linear modulating agent based on cadherin-7 cell adhesion recognition sequence
EPKT

SEQ ID NO: 198 - protein, 5 aa, Artificial Sequence
  Representative linear modulating agent based on cadherin-7 cell adhesion recognition sequence
EPKTG

SEQ ID NO: 199 - protein, 4 aa, Artificial Sequence
  Representative linear modulating agent based on cadherin-7 cell adhesion recognition sequence
VEPK

SEQ ID NO: 200 - protein, 5 aa, Artificial Sequence
  Representative linear modulating agent based on cadherin-7 cell adhesion recognition sequence
VEPKT

SEQ ID NO: 201 - protein, 6 aa, Artificial Sequence
  Representative linear modulating agent based on cadherin-7 cell adhesion recognition sequence
VEPKTG

SEQ ID NO: 202 - protein, 5 aa, Artificial Sequence
  Representative linear modulating agent based on cadherin-7 cell adhesion recognition sequence
SVEPK

SEQ ID NO: 203 - protein, 6 aa, Artificial Sequence
  Representative linear modulating agent based on cadherin-7 cell adhesion recognition sequence
SVEPKT

SEQ ID NO: 204 - protein, 7 aa, Artificial Sequence
  Representative linear modulating agent based on cadherin-7 cell adhesion recognition sequence
SVEPKTG

SEQ ID NO: 205 - protein, 6 aa, Artificial Sequence
  Representative linear modulating agent based on cadherin-7 cell adhesion recognition sequence
FSVEPK

SEQ ID NO: 206 - protein, 7 aa, Artificial Sequence
  Representative linear modulating agent based on cadherin-7 cell adhesion recognition sequence
FSVEPKT

SEQ ID NO: 207 - protein, 8 aa, Artificial Sequence
  Representative linear modulating agent based on cadherin-7 cell adhesion recognition sequence
FSVEPKTG

SEQ ID NO: 208 - protein, 7 aa, Artificial Sequence
  Representative linear modulating agent based on cadherin-7 cell adhesion recognition sequence
YFSVEPK

SEQ ID NO: 209 - protein, 8 aa, Artificial Sequence
  Representative linear modulating agent based on cadherin-7 cell adhesion recognition sequence
YFSVEPKT

SEQ ID NO: 210 - protein, 9 aa, Artificial Sequence
  Representative linear modulating agent based on cadherin-7 cell adhesion recognition sequence
YFSVEPKTG

SEQ ID NO: 211 - protein, 4 aa, Artificial Sequence
  Representative linear modulating agent based on cadherin-7 cell adhesion recognition sequence
DANS

SEQ ID NO: 212 - protein, 5 aa, Artificial Sequence
  Representative linear modulating agent based on cadherin-7 cell adhesion recognition sequence
DANSG

SEQ ID NO: 213 - protein, 4 aa, Artificial Sequence
  Representative linear modulating agent based on cadherin-7 cell adhesion recognition sequence
IDAN

SEQ ID NO: 214 - protein, 5 aa, Artificial Sequence
  Representative linear modulating agent based on cadherin-7 cell adhesion recognition sequence
IDANS

SEQ ID NO: 215 - protein, 6 aa, Artificial Sequence
  Representative linear modulating agent based on cadherin-7 cell adhesion recognition sequence
IDANSG

SEQ ID NO: 216 - protein, 5 aa, Artificial Sequence
  Representative linear modulating agent based on cadherin-7 cell adhesion recognition sequence
NIDAN

SEQ ID NO: 217 - protein, 6 aa, Artificial Sequence
  Representative linear modulating agent based on cadherin-7 cell adhesion recognition sequence
NIDANS

SEQ ID NO: 218 - protein, 7 aa, Artificial Sequence
  Representative linear modulating agent based on cadherin-7 cell adhesion recognition sequence
NIDANSG

SEQ ID NO: 219 - protein, 6 aa, Artificial Sequence
  Representative linear modulating agent based on cadherin-7 cell adhesion recognition sequence
FNIDAN

SEQ ID NO: 220 - protein, 7 aa, Artificial Sequence
  Representative linear modulating agent based on cadherin-7 cell adhesion recognition sequence
FNIDANS

SEQ ID NO: 221 - protein, 8 aa, Artificial Sequence
  Representative linear modulating agent based on cadherin-7 cell adhesion recognition sequence
FNIDANSG

SEQ ID NO: 222 - protein, 7 aa, Artificial Sequence
  Representative linear modulating agent based on cadherin-7 cell adhesion recognition sequence
YFNIDAN

SEQ ID NO: 223 - protein, 8 aa, Artificial Sequence
  Representative linear modulating agent based on cadherin-7 cell adhesion recognition sequence
YFNIDANS

SEQ ID NO: 224 - protein, 9 aa, Artificial Sequence
  Representative linear modulating agent based on cadherin-7 cell adhesion recognition sequence
YFNIDANSG

SEQ ID NO: 225 - protein, 4 aa, Artificial Sequence
  Representative linear modulating agent based on cadherin-8 cell adhesion recognition sequence
INDV

SEQ ID NO: 226 - protein, 4 aa, Artificial Sequence
  Representative linear modulating agent based on cadherin-8 cell adhesion recognition sequence
NDVT

SEQ ID NO: 227 - protein, 5 aa, Artificial Sequence
  Representative linear modulating agent based on cadherin-8 cell adhesion recognition sequence
QINDV

SEQ ID NO: 228 - protein, 5 aa, Artificial Sequence
  Representative linear modulating agent based on cadherin-8 cell adhesion recognition sequence
INDVT

SEQ ID NO: 229 - protein, 6 aa, Artificial Sequence
  Representative linear modulating agent based on cadherin-8 cell adhesion recognition sequence
QINDVT

SEQ ID NO: 230 - protein, 5 aa, Artificial Sequence
  Representative linear modulating agent based on cadherin-8 cell adhesion recognition sequence
NDVTG

SEQ ID NO: 231 - protein, 6 aa, Artificial Sequence
  Representative linear modulating agent based on cadherin-8 cell adhesion recognition sequence
INDVTG

SEQ ID NO: 232 - protein, 7 aa, Artificial Sequence
  Representative linear modulating agent based on cadherin-8 cell adhesion recognition sequence
QINDVTG

SEQ ID NO: 233 - protein, 6 aa, Artificial Sequence
  Representative linear modulating agent based on cadherin-8 cell adhesion recognition sequence
FQINDV

SEQ ID NO: 234 - protein, 7 aa, Artificial Sequence
  Representative linear modulating agent based on cadherin-8 cell adhesion recognition sequence
FQINDVT

SEQ ID NO: 235 - protein, 8 aa, Artificial Sequence
  Representative linear modulating agent based on cadherin-8 cell adhesion recognition sequence
FQINDVTG

SEQ ID NO: 236 - protein, 7 aa, Artificial Sequence
  Representative linear modulating agent based on cadherin-8 cell adhesion recognition sequence
IFQINDV

SEQ ID NO: 237 - protein, 8 aa, Artificial Sequence
  Representative linear modulating agent based on cadherin-8 cell adhesion recognition sequence
IFQINDVT

SEQ ID NO: 238 - protein, 9 aa, Artificial Sequence
  Representative linear modulating agent based on cadherin-8 cell adhesion recognition sequence
IFQINDVTG

SEQ ID NO: 239 - protein, 4 aa, Artificial Sequence
  Representative linear modulating agent based on cadherin-8 cell adhesion recognition sequence
EEFS

SEQ ID NO: 240 - protein, 5 aa, Artificial Sequence
  Representative linear modulating agent based on cadherin-8 cell adhesion recognition sequence
EEFSG

SEQ ID NO: 241 - protein, 4 aa, Artificial Sequence
  Representative linear modulating agent based on cadherin-8 cell adhesion recognition sequence
LEEF

SEQ ID NO: 242 - protein, 5 aa, Artificial Sequence
  Representative linear modulating agent based on cadherin-8 cell adhesion recognition sequence
LEEFS

SEQ ID NO: 243 - protein, 6 aa, Artificial Sequence
  Representative linear modulating agent based on cadherin-8 cell adhesion recognition sequence
LEEFSG

SEQ ID NO: 244 - protein, 5 aa, Artificial Sequence
  Representative linear modulating agent based on cadherin-8 cell adhesion recognition sequence
VLEEF

SEQ ID NO: 245 - protein, 6 aa, Artificial Sequence
  Representative linear modulating agent based on cadherin-8 cell adhesion recognition sequence
VLEEFS

SEQ ID NO: 246 - protein, 7 aa, Artificial Sequence
  Representative linear modulating agent based on cadherin-8 cell adhesion recognition sequence
VLEEFSG

SEQ ID NO: 247 - protein, 6 aa, Artificial Sequence
  Representative linear modulating agent based on cadherin-8 cell adhesion recognition sequence
FVLEEF

SEQ ID NO: 248 - protein, 7 aa, Artificial Sequence
  Representative linear modulating agent based on cadherin-8 cell adhesion recognition sequence
FVLEEFS

SEQ ID NO: 249 - protein, 8 aa, Artificial Sequence
  Representative linear modulating agent based on cadherin-8 cell adhesion recognition sequence
FVLEEFSG

SEQ ID NO: 250 - protein, 7 aa, Artificial Sequence
  Representative linear modulating agent based on cadherin-8 cell adhesion recognition sequence
MFVLEEF

SEQ ID NO: 251 - protein, 8 aa, Artificial Sequence
  Representative linear modulating agent based on cadherin-8 cell adhesion recognition sequence
MFVLEEFS

SEQ ID NO: 252 - protein, 9 aa, Artificial Sequence
  Representative linear modulating agent based on cadherin-8 cell adhesion recognition sequence
MFVLEEFSG

SEQ ID NO: 253 - protein, 4 aa, Artificial Sequence
  Representative linear modulating agent based on cadherin-12 cell adhesion recognition sequence
IDET

SEQ ID NO: 254 - protein, 4 aa, Artificial Sequence
  Representative linear modulating agent based on cadherin-12 cell adhesion recognition sequence
DETT

SEQ ID NO: 255 - protein, 5 aa, Artificial Sequence
  Representative linear modulating agent based on cadherin-12 cell adhesion recognition sequence
TIDET

SEQ ID NO: 256 - protein, 5 aa, Artificial Sequence
  Representative linear modulating agent based on cadherin-12 cell adhesion recognition sequence
IDETT

SEQ ID NO: 257 - protein, 6 aa, Artificial Sequence
  Representative linear modulating agent based on cadherin-12 cell adhesion recognition sequence
TIDETT

SEQ ID NO: 258 - protein, 5 aa, Artificial Sequence
  Representative linear modulating agent based on cadherin-12 cell adhesion recognition sequence
DETTG

SEQ ID NO: 259 - protein, 6 aa, Artificial Sequence
  Representative linear modulating agent based on cadherin-12 cell adhesion recognition sequence
IDETTG

SEQ ID NO: 260 - protein, 7 aa, Artificial Sequence
  Representative linear modulating agent based on cadherin-12 cell adhesion recognition sequence
TIDETTG

SEQ ID NO: 261 - protein, 6 aa, Artificial Sequence
  Representative linear modulating agent based on cadherin-12 cell adhesion recognition sequence
FTIDET

SEQ ID NO: 262 - protein, 7 aa, Artificial Sequence
  Representative linear modulating agent based on cadherin-12 cell adhesion recognition sequence
FTIDETT

SEQ ID NO: 263 - protein, 8 aa, Artificial Sequence
  Representative linear modulating agent based on cadherin-12 cell adhesion recognition sequence
FTIDETTG

SEQ ID NO: 264 - protein, 7 aa, Artificial Sequence
  Representative linear modulating agent based on cadherin-12 cell adhesion recognition sequence
VFTIDET

SEQ ID NO: 265 - protein, 8 aa, Artificial Sequence
  Representative linear modulating agent based on cadherin-12 cell adhesion recognition sequence
VFTIDETT

SEQ ID NO: 266 - protein, 9 aa, Artificial Sequence
  Representative linear modulating agent based on cadherin-12 cell adhesion recognition sequence
VFTIDETTG

SEQ ID NO: 267 - protein, 4 aa, Artificial Sequence
  Representative linear modulating agent based on cadherin-12 cell adhesion recognition sequence
DPKT

SEQ ID NO: 268 - protein, 5 aa, Artificial Sequence
  Representative linear modulating agent based on cadherin-12 cell adhesion recognition sequence
DPKTG

SEQ ID NO: 269 - protein, 4 aa, Artificial Sequence
  Representative linear modulating agent based on cadherin-12 cell adhesion recognition sequence
IDPK

SEQ ID NO: 270 - protein, 5 aa, Artificial Sequence
  Representative linear modulating agent based on cadherin-12 cell adhesion recognition sequence
IDPKT

SEQ ID NO: 271 - protein, 6 aa, Artificial Sequence
  Representative linear modulating agent based on cadherin-12 cell adhesion recognition sequence
IDPKTG

SEQ ID NO: 272 - protein, 5 aa, Artificial Sequence
  Representative linear modulating agent based on cadherin-12 cell adhesion recognition sequence
SIDPK

SEQ ID NO: 273 - protein, 6 aa, Artificial Sequence
  Representative linear modulating agent based on cadherin-12 cell adhesion recognition sequence
SIDPKT

SEQ ID NO: 274 - protein, 7 aa, Artificial Sequence
  Representative linear modulating agent based on cadherin-12 cell adhesion recognition sequence
SIDPKTG

SEQ ID NO: 275 - protein, 6 aa, Artificial Sequence
  Representative linear modulating agent based on cadherin-12 cell adhesion recognition sequence
FSIDPK

SEQ ID NO: 276 - protein, 7 aa, Artificial Sequence
  Representative linear modulating agent based on cadherin-12 cell adhesion recognition sequence
FSIDPKT

SEQ ID NO: 277 - protein, 8 aa, Artificial Sequence
  Representative linear modulating agent based on cadherin-12 cell adhesion recognition sequence
FSIDPKTG

SEQ ID NO: 278 - protein, 7 aa, Artificial Sequence
  Representative linear modulating agent based on cadherin-12 cell adhesion recognition sequence
YFSIDPK

SEQ ID NO: 279 - protein, 8 aa, Artificial Sequence
  Representative linear modulating agent based on cadherin-12 cell adhesion recognition sequence
YFSIDPKT

SEQ ID NO: 280 - protein, 9 aa, Artificial Sequence
  Representative linear modulating agent based on cadherin-12 cell adhesion recognition sequence
YFSIDPKTG

SEQ ID NO: 281 - protein, 4 aa, Artificial Sequence
  Representative linear modulating agent based on cadherin-14 cell adhesion recognition sequence
IDDT

SEQ ID NO: 282 - protein, 4 aa, Artificial Sequence
  Representative linear modulating agent based on cadherin-14 cell adhesion recognition sequence
DDTT

SEQ ID NO: 283 - protein, 5 aa, Artificial Sequence
  Representative linear modulating agent based on cadherin-14 cell adhesion recognition sequence
IIDDT

SEQ ID NO: 284 - protein, 5 aa, Artificial Sequence
  Representative linear modulating agent based on cadherin-14 cell adhesion recognition sequence
IDDTT

SEQ ID NO: 285 - protein, 6 aa, Artificial Sequence
  Representative linear modulating agent based on cadherin-14 cell adhesion recognition sequence
IIDDTT

SEQ ID NO: 286 - protein, 5 aa, Artificial Sequence
  Representative linear modulating agent based on cadherin-14 cell adhesion recognition sequence
DDTTG

SEQ ID NO: 287 - protein, 6 aa, Artificial Sequence
  Representative linear modulating agent based on cadherin-14 cell adhesion recognition sequence
IDDTTG

SEQ ID NO: 288 - protein, 7 aa, Artificial Sequence
  Representative linear modulating agent based on cadherin-14 cell adhesion recognition sequence
IIDDTTG

SEQ ID NO: 289 - protein, 6 aa, Artificial Sequence
  Representative linear modulating agent based on cadherin-14 cell adhesion recognition sequence
FIIDDT

SEQ ID NO: 290 - protein, 7 aa, Artificial Sequence
  Representative linear modulating agent based on cadherin-14 cell adhesion recognition sequence
FIIDDTT

SEQ ID NO: 291 - protein, 8 aa, Artificial Sequence
  Representative linear modulating agent based on cadherin-14 cell adhesion recognition sequence
FIIDDTTG

SEQ ID NO: 292 - protein, 7 aa, Artificial Sequence
  Representative linear modulating agent based on cadherin-14 cell adhesion recognition sequence
IFIIDDT

SEQ ID NO: 293 - protein, 8 aa, Artificial Sequence
  Representative linear modulating agent based on cadherin-14 cell adhesion recognition sequence
IFIIDDTT

SEQ ID NO: 294 - protein, 9 aa, Artificial Sequence
  Representative linear modulating agent based on cadherin-14 cell adhesion recognition sequence
IFIIDDTTG

SEQ ID NO: 295 - protein, 4 aa, Artificial Sequence
  Representative linear modulating agent based on cadherin-14 cell adhesion recognition sequence
DPKT

SEQ ID NO: 296 - protein, 5 aa, Artificial Sequence
  Representative linear modulating agent based on cadherin-14 cell adhesion recognition sequence
DPKTG

SEQ ID NO: 297 - protein, 4 aa, Artificial Sequence
  Representative linear modulating agent based on cadherin-14 cell adhesion recognition sequence
VDPK

SEQ ID NO: 298 - protein, 5 aa, Artificial Sequence
  Representative linear modulating agent based on cadherin-14 cell adhesion recognition sequence
VDPKT

SEQ ID NO: 299 - protein, 6 aa, Artificial Sequence
  Representative linear modulating agent based on cadherin-14 cell adhesion recognition sequence
VDPKTG

SEQ ID NO: 300 - protein, 5 aa, Artificial Sequence
  Representative linear modulating agent based on cadherin-14 cell adhesion recognition sequence
SVDPK

SEQ ID NO: 301 - protein, 6 aa, Artificial Sequence
  Representative linear modulating agent based on cadherin-14 cell adhesion recognition sequence
SVDPKT

SEQ ID NO: 302 - protein, 7 aa, Artificial Sequence
  Representative linear modulating agent based on cadherin-14 cell adhesion recognition sequence
SVDPKTG

SEQ ID NO: 303 - protein, 6 aa, Artificial Sequence
  Representative linear modulating agent based on cadherin-14 cell adhesion recognition sequence
FSVDPK

SEQ ID NO: 304 - protein, 7 aa, Artificial Sequence
  Representative linear modulating agent based on cadherin-14 cell adhesion recognition sequence
FSVDPKT

SEQ ID NO: 305 - protein, 8 aa, Artificial Sequence
  Representative linear modulating agent based on cadherin-14 cell adhesion recognition sequence
FSVDPKTG

SEQ ID NO: 306 - protein, 7 aa, Artificial Sequence
  Representative linear modulating agent based on cadherin-14 cell adhesion recognition sequence
YFSVDPK

SEQ ID NO: 307 - protein, 8 aa, Artificial Sequence
  Representative linear modulating agent based on cadherin-14 cell adhesion recognition sequence
YFSVDPKT

SEQ ID NO: 308 - protein, 9 aa, Artificial Sequence
  Representative linear modulating agent based on cadherin-14 cell adhesion recognition sequence
YFSVDPKTG

SEQ ID NO: 309 - protein, 4 aa, Artificial Sequence
  Representative linear modulating agent based on cadherin-14 cell adhesion recognition sequence
DANT

SEQ ID NO: 310 - protein, 5 aa, Artificial Sequence
  Representative linear modulating agent based on cadherin-14 cell adhesion recognition sequence
DANTG

SEQ ID NO: 311 - protein, 5 aa, Artificial Sequence
  Representative linear modulating agent based on cadherin-14 cell adhesion recognition sequence
IDANT

SEQ ID NO: 312 - protein, 6 aa, Artificial Sequence
  Representative linear modulating agent based on cadherin-14 cell adhesion recognition sequence
IDANTG

SEQ ID NO: 313 - protein, 6 aa, Artificial Sequence
  Representative linear modulating agent based on cadherin-14 cell adhesion recognition sequence
NIDANT

SEQ ID NO: 314 - protein, 7 aa, Artificial Sequence
  Representative linear modulating agent based on cadherin-14 cell adhesion recognition sequence
NIDANTG

SEQ ID NO: 315 - protein, 7 aa, Artificial Sequence
  Representative linear modulating agent based on cadherin-14 cell adhesion recognition sequence
FNIDANT

SEQ ID NO: 316 - protein, 8 aa, Artificial Sequence
  Representative linear modulating agent based on cadherin-14 cell adhesion recognition sequence
FNIDANTG

SEQ ID NO: 317 - protein, 7 aa, Artificial Sequence
  Representative linear modulating agent based on cadherin-14 cell adhesion recognition sequence
FFNIDAN

SEQ ID NO: 318 - protein, 8 aa, Artificial Sequence
  Representative linear modulating agent based on cadherin-14 cell adhesion recognition sequence
FFNIDANT

SEQ ID NO: 319 - protein, 9 aa, Artificial Sequence
  Representative linear modulating agent based on cadherin-14 cell adhesion recognition sequence
FFNIDANTG

SEQ ID NO: 320 - protein, 4 aa, Artificial Sequence
  Representative linear modulating agent based on cadherin-15 cell adhesion recognition sequence
IDKF

SEQ ID NO: 321 - protein, 4 aa, Artificial Sequence
  Representative linear modulating agent based on cadherin-15 cell adhesion recognition sequence
DKFT

SEQ ID NO: 322 - protein, 5 aa, Artificial Sequence
  Representative linear modulating agent based on cadherin-15 cell adhesion recognition sequence
SIDKF

SEQ ID NO: 323 - protein, 5 aa, Artificial Sequence
  Representative linear modulating agent based on cadherin-15 cell adhesion recognition sequence
IDKFT

SEQ ID NO: 324 - protein, 6 aa, Artificial Sequence
  Representative linear modulating agent based on cadherin-15 cell adhesion recognition sequence
SIDKFT

SEQ ID NO: 325 - protein, 5 aa, Artificial Sequence
  Representative linear modulating agent based on cadherin-15 cell adhesion recognition sequence
DKFTG

SEQ ID NO: 326 - protein, 6 aa, Artificial Sequence
  Representative linear modulating agent based on cadherin-15 cell adhesion recognition sequence
IDKFTG

SEQ ID NO: 327 - protein, 7 aa, Artificial Sequence
  Representative linear modulating agent based on cadherin-15 cell adhesion recognition sequence
SIDKFTG

SEQ ID NO: 328 - protein, 6 aa, Artificial Sequence
  Representative linear modulating agent based on cadherin-15 cell adhesion recognition sequence
FSIDKF

SEQ ID NO: 329 - protein, 7 aa, Artificial Sequence
  Representative linear modulating agent based on cadherin-15 cell adhesion recognition sequence
FSIDKFT

SEQ ID NO: 330 - protein, 8 aa, Artificial Sequence
  Representative linear modulating agent based on cadherin-15 cell adhesion recognition sequence
FSIDKFTG

SEQ ID NO: 331 - protein, 7 aa, Artificial Sequence
  Representative linear modulating agent based on cadherin-15 cell adhesion recognition sequence
VFSIDKF

SEQ ID NO: 332 - protein, 8 aa, Artificial Sequence
  Representative linear modulating agent based on cadherin-15 cell adhesion recognition sequence
VFSIDKFT

SEQ ID NO: 333 - protein, 9 aa, Artificial Sequence
  Representative linear modulating agent based on cadherin-15 cell adhesion recognition sequence
VFSIDKFTG

SEQ ID NO: 334 - protein, 4 aa, Artificial Sequence
  Representative linear modulating agent based on cadherin-15 cell adhesion recognition sequence
DELT

SEQ ID NO: 335 - protein, 5 aa, Artificial Sequence
  Representative linear modulating agent based on cadherin-15 cell adhesion recognition sequence
DELTG

SEQ ID NO: 336 - protein, 4 aa, Artificial Sequence
  Representative linear modulating agent based on cadherin-15 cell adhesion recognition sequence
IDEL

SEQ ID NO: 337 - protein, 5 aa, Artificial Sequence
  Representative linear modulating agent based on cadherin-15 cell adhesion recognition sequence
IDELT

SEQ ID NO: 338 - protein, 6 aa, Artificial Sequence
  Representative linear modulating agent based on cadherin-15 cell adhesion recognition sequence
IDELTG

SEQ ID NO: 339 - protein, 5 aa, Artificial Sequence
  Representative linear modulating agent based on cadherin-15 cell adhesion recognition sequence
SIDEL

SEQ ID NO: 340 - protein, 6 aa, Artificial Sequence
  Representative linear modulating agent based on cadherin-15 cell adhesion recognition sequence
SIDELT

SEQ ID NO: 341 - protein, 7 aa, Artificial Sequence
  Representative linear modulating agent based on cadherin-15 cell adhesion recognition sequence
SIDELTG

SEQ ID NO: 342 - protein, 6 aa, Artificial Sequence
  Representative linear modulating agent based on cadherin-15 cell adhesion recognition sequence
FSIDEL

SEQ ID NO: 343 - protein, 7 aa, Artificial Sequence
  Representative linear modulating agent based on cadherin-15 cell adhesion recognition sequence
FSIDELT

SEQ ID NO: 344 - protein, 8 aa, Artificial Sequence
  Representative linear modulating agent based on cadherin-15 cell adhesion recognition sequence
FSIDELTG

SEQ ID NO: 345 - protein, 7 aa, Artificial Sequence
  Representative linear modulating agent based on cadherin-15 cell adhesion recognition sequence
LFSIDEL

SEQ ID NO: 346 - protein, 8 aa, Artificial Sequence
  Representative linear modulating agent based on cadherin-15 cell adhesion recognition sequence
LFSIDELT

SEQ ID NO: 347 - protein, 9 aa, Artificial Sequence
  Representative linear modulating agent based on cadherin-15 cell adhesion recognition sequence
LFSIDELTG

SEQ ID NO: 348 - protein, 4 aa, Artificial Sequence
  Representative linear modulating agent based on T-cadherin cell adhesion recognition sequence
INEN

SEQ ID NO: 349 - protein, 4 aa, Artificial Sequence
  Representative linear modulating agent based on T-cadherin cell adhesion recognition sequence
NENT

SEQ ID NO: 350 - protein, 5 aa, Artificial Sequence
  Representative linear modulating agent based on T-cadherin cell adhesion recognition sequence
RINEN

SEQ ID NO: 351 - protein, 5 aa, Artificial Sequence
  Representative linear modulating agent based on T-cadherin cell adhesion recognition sequence
INENT

SEQ ID NO: 352 - protein, 6 aa, Artificial Sequence
  Representative linear modulating agent based on T-cadherin cell adhesion recognition sequence
RINENT

SEQ ID NO: 353 - protein, 5 aa, Artificial Sequence
  Representative linear modulating agent based on T-cadherin cell adhesion recognition sequence
NENTG

SEQ ID NO: 354 - protein, 6 aa, Artificial Sequence
  Representative linear modulating agent based on T-cadherin cell adhesion recognition sequence
INENTG

SEQ ID NO: 355 - protein, 7 aa, Artificial Sequence
  Representative linear modulating agent based on T-cadherin cell adhesion recognition sequence
RINENTG

SEQ ID NO: 356 - protein, 6 aa, Artificial Sequence
  Representative linear modulating agent based on T-cadherin cell adhesion recognition sequence
FRINEN

SEQ ID NO: 357 - protein, 7 aa, Artificial Sequence
  Representative linear modulating agent based on T-cadherin cell adhesion recognition sequence
FRINENT

SEQ ID NO: 358 - protein, 8 aa, Artificial Sequence
  Representative linear modulating agent based on T-cadherin cell adhesion recognition sequence
FRINENTG

SEQ ID NO: 359 - protein, 7 aa, Artificial Sequence
  Representative linear modulating agent based on T-cadherin cell adhesion recognition sequence
IFRINEN

SEQ ID NO: 360 - protein, 8 aa, Artificial Sequence
  Representative linear modulating agent based on T-cadherin cell adhesion recognition sequence
IFRINENT

SEQ ID NO: 361 - protein, 9 aa, Artificial Sequence
  Representative linear modulating agent based on T-cadherin cell adhesion recognition sequence
IFRINENTG

SEQ ID NO: 362 - protein, 4 aa, Artificial Sequence
  Representative linear modulating agent based on PB-cadherin cell adhesion recognition sequence
EEYT

SEQ ID NO: 363 - protein, 5 aa, Artificial Sequence
  Representative linear modulating agent based on PB-cadherin cell adhesion recognition sequence
EEYTG

SEQ ID NO: 364 - protein, 4 aa, Artificial Sequence
  Representative linear modulating agent based on PB-cadherin cell adhesion recognition sequence
VEEY

SEQ ID NO: 365 - protein, 5 aa, Artificial Sequence
  Representative linear modulating agent based on PB-cadherin cell adhesion recognition sequence
VEEYT

SEQ ID NO: 366 - protein, 6 aa, Artificial Sequence
  Representative linear modulating agent based on PB-cadherin cell adhesion recognition sequence
VEEYTG

SEQ ID NO: 367 - protein, 5 aa, Artificial Sequence
  Representative linear modulating agent based on PB-cadherin cell adhesion recognition sequence
VVEEY

SEQ ID NO: 368 - protein, 6 aa, Artificial Sequence
  Representative linear modulating agent based on PB-cadherin cell adhesion recognition sequence
VVEEYT

SEQ ID NO: 369 - protein, 7 aa, Artificial Sequence
  Representative linear modulating agent based on PB-cadherin cell adhesion recognition sequence
VVEEYTG

SEQ ID NO: 370 - protein, 6 aa, Artificial Sequence
  Representative linear modulating agent based on PB-cadherin cell adhesion recognition sequence
FVVEEY

SEQ ID NO: 371 - protein, 6 aa, Artificial Sequence
  Representative linear modulating agent based on PB-cadherin cell adhesion recognition sequence
FVEEYT

SEQ ID NO: 372 - protein, 7 aa, Artificial Sequence
  Representative linear modulating agent based on PB-cadherin cell adhesion recognition sequence
FVEEYTG

SEQ ID NO: 373 - protein, 7 aa, Artificial Sequence
  Representative linear modulating agent based on PB-cadherin cell adhesion recognition sequence
FFVVEEY

SEQ ID NO: 374 - protein, 8 aa, Artificial Sequence
  Representative linear modulating agent based on PB-cadherin cell adhesion recognition sequence
FFVVEEYT

SEQ ID NO: 375 - protein, 9 aa, Artificial Sequence
  Representative linear modulating agent based on PB-cadherin cell adhesion recognition sequence
FFVVEEYTG

SEQ ID NO: 376 - protein, 4 aa, Artificial Sequence
  Representative linear modulating agent based on PB-cadherin cell adhesion recognition sequence
DELT

SEQ ID NO: 377 - protein, 5 aa, Artificial Sequence
  Representative linear modulating agent based on PB-cadherin cell adhesion recognition sequence
DELTG

SEQ ID NO: 378 - protein, 4 aa, Artificial Sequence
  Representative linear modulating agent based on PB-cadherin cell adhesion recognition sequence
IDEL

SEQ ID NO: 379 - protein, 5 aa, Artificial Sequence
  Representative linear modulating agent based on PB-cadherin cell adhesion recognition sequence
IDELT

SEQ ID NO: 380 - protein, 6 aa, Artificial Sequence
  Representative linear modulating agent based on PB-cadherin cell adhesion recognition sequence
IDELTG

SEQ ID NO: 381 - protein, 5 aa, Artificial Sequence
  Representative linear modulating agent based on PB-cadherin cell adhesion recognition sequence
LIDEL

SEQ ID NO: 382 - protein, 6 aa, Artificial Sequence
  Representative linear modulating agent based on PB-cadherin cell adhesion recognition sequence
LIDELT

SEQ ID NO: 383 - protein, 7 aa, Artificial Sequence
  Representative linear modulating agent based on PB-cadherin cell adhesion recognition sequence
LIDELTG

SEQ ID NO: 384 - protein, 6 aa, Artificial Sequence
  Representative linear modulating agent based on PB-cadherin cell adhesion recognition sequence
FLIDEL

SEQ ID NO: 385 - protein, 7 aa, Artificial Sequence
  Representative linear modulating agent based on PB-cadherin cell adhesion recognition sequence
FLIDELT

SEQ ID NO: 386 - protein, 8 aa, Artificial Sequence
  Representative linear modulating agent based on PB-cadherin cell adhesion recognition sequence
FLIDELTG

SEQ ID NO: 387 - protein, 7 aa, Artificial Sequence
  Representative linear modulating agent based on PB-cadherin cell adhesion recognition sequence
IFLIDEL

SEQ ID NO: 388 - protein, 8 aa, Artificial Sequence
  Representative linear modulating agent based on PB-cadherin cell adhesion recognition sequence
IFLIDELT

SEQ ID NO: 389 - protein, 9 aa, Artificial Sequence
  Representative linear modulating agent based on PB-cadherin cell adhesion recognition sequence
IFLIDELTG

SEQ ID NO: 390 - protein, 4 aa, Artificial Sequence
  Representative linear modulating agent based on PB-cadherin cell adhesion recognition sequence
DPKT

SEQ ID NO: 391 - protein, 5 aa, Artificial Sequence
  Representative linear modulating agent based on PB-cadherin cell adhesion recognition sequence
DPKTG

SEQ ID NO: 392 - protein, 4 aa, Artificial Sequence
  Representative linear modulating agent based on PB-cadherin cell adhesion recognition sequence
VDPK

SEQ ID NO: 393 - protein, 5 aa, Artificial Sequence
  Representative linear modulating agent based on PB-cadherin cell adhesion recognition sequence
VDPKT

SEQ ID NO: 394 - protein, 6 aa, Artificial Sequence
  Representative linear modulating agent based on PB-cadherin cell adhesion recognition sequence
VDPKTG

SEQ ID NO: 395 - protein, 5 aa, Artificial Sequence
  Representative linear modulating agent based on PB-cadherin cell adhesion recognition sequence
TVDPK

SEQ ID NO: 396 - protein, 6 aa, Artificial Sequence
  Representative linear modulating agent based on PB-cadherin cell adhesion recognition sequence
TVDPKT

SEQ ID NO: 397 - protein, 7 aa, Artificial Sequence
  Representative linear modulating agent based on PB-cadherin cell adhesion recognition sequence
TVDPKTG

SEQ ID NO: 398 - protein, 6 aa, Artificial Sequence
  Representative linear modulating agent based on PB-cadherin cell adhesion recognition sequence
FTVDPK

SEQ ID NO: 399 - protein, 7 aa, Artificial Sequence
  Representative linear modulating agent based on PB-cadherin cell adhesion recognition sequence
FTVDPKT

SEQ ID NO: 400 - protein, 8 aa, Artificial Sequence
  Representative linear modulating agent based on PB-cadherin cell adhesion recognition sequence
FTVDPKTG

SEQ ID NO: 401 - protein, 7 aa, Artificial Sequence
  Representative linear modulating agent based on PB-cadherin cell adhesion recognition sequence
HFTVDPK

SEQ ID NO: 402 - protein, 8 aa, Artificial Sequence
  Representative linear modulating agent based on PB-cadherin cell adhesion recognition sequence
HFTVDPKT

SEQ ID NO: 403 - protein, 9 aa, Artificial Sequence
  Representative linear modulating agent based on PB-cadherin cell adhesion recognition sequence
HFTVDPKTG

SEQ ID NO: 404 - protein, 4 aa, Artificial Sequence
  Representative linear modulating agent based on PB-cadherin cell adhesion recognition sequence
DADT

SEQ ID NO: 405 - protein, 5 aa, Artificial Sequence
  Representative linear modulating agent based on PB-cadherin cell adhesion recognition sequence
DADTG

SEQ ID NO: 406 - protein, 4 aa, Artificial Sequence
  Representative linear modulating agent based on PB-cadherin cell adhesion recognition sequence
IDAD

SEQ ID NO: 407 - protein, 5 aa, Artificial Sequence
  Representative linear modulating agent based on PB-cadherin cell adhesion recognition sequence
IDADT

SEQ ID NO: 408 - protein, 6 aa, Artificial Sequence
  Representative linear modulating agent based on PB-cadherin cell adhesion recognition sequence
IDADTG

SEQ ID NO: 409 - protein, 5 aa, Artificial Sequence
  Representative linear modulating agent based on PB-cadherin cell adhesion recognition sequence
DIDAD

SEQ ID NO: 410 - protein, 6 aa, Artificial Sequence
  Representative linear modulating agent based on PB-cadherin cell adhesion recognition sequence
DIDADT

SEQ ID NO: 411 - protein, 7 aa, Artificial Sequence
  Representative linear modulating agent based on PB-cadherin cell adhesion recognition sequence
DIDADTG

SEQ ID NO: 412 - protein, 6 aa, Artificial Sequence
  Representative linear modulating agent based on PB-cadherin cell adhesion recognition sequence
FDIDAD

SEQ ID NO: 413 - protein, 7 aa, Artificial Sequence
  Representative linear modulating agent based on PB-cadherin cell adhesion recognition sequence
FDIDADT

SEQ ID NO: 414 - protein, 8 aa, Artificial Sequence
  Representative linear modulating agent based on PB-cadherin cell adhesion recognition sequence
FDIDADTG

SEQ ID NO: 415 - protein, 7 aa, Artificial Sequence
  Representative linear modulating agent based on PB-cadherin cell adhesion recognition sequence
IFDIDAD

SEQ ID NO: 416 - protein, 8 aa, Artificial Sequence
  Representative linear modulating agent based on PB-cadherin cell adhesion recognition sequence
IFDIDADT

SEQ ID NO: 417 - protein, 9 aa, Artificial Sequence
  Representative linear modulating agent based on PB-cadherin cell adhesion recognition sequence
IFDIDADTG

SEQ ID NO: 418 - protein, 4 aa, Artificial Sequence
  Representative linear modulating agent based on LI-cadherin cell adhesion recognition sequence
NNKT

SEQ ID NO: 419 - protein, 5 aa, Artificial Sequence
  Representative linear modulating agent based on LI-cadherin cell adhesion recognition sequence
NNKTG

SEQ ID NO: 420 - protein, 4 aa, Artificial Sequence
  Representative linear modulating agent based on LI-cadherin cell adhesion recognition sequence
INNK

SEQ ID NO: 421 - protein, 5 aa, Artificial Sequence
  Representative linear modulating agent based on LI-cadherin cell adhesion recognition sequence
INNKT

SEQ ID NO: 422 - protein, 6 aa, Artificial Sequence
  Representative linear modulating agent based on LI-cadherin cell adhesion recognition sequence
INNKTG

SEQ ID NO: 423 - protein, 5 aa, Artificial Sequence
  Representative linear modulating agent based on LI-cadherin cell adhesion recognition sequence
QINNK

SEQ ID NO: 424 - protein, 6 aa, Artificial Sequence
  Representative linear modulating agent based on LI-cadherin cell adhesion recognition sequence
QINNKT

SEQ ID NO: 425 - protein, 7 aa, Artificial Sequence
  Representative linear modulating agent based on LI-cadherin cell adhesion recognition sequence
QINNKTG

SEQ ID NO: 426 - protein, 6 aa, Artificial Sequence
  Representative linear modulating agent based on LI-cadherin cell adhesion recognition sequence
FQINNK

SEQ ID NO: 427 - protein, 7 aa, Artificial Sequence
  Representative linear modulating agent based on LI-cadherin cell adhesion recognition sequence
FQINNKT

SEQ ID NO: 428 - protein, 8 aa, Artificial Sequence
  Representative linear modulating agent based on LI-cadherin cell adhesion recognition sequence
FQINNKTG

SEQ ID NO: 429 - protein, 7 aa, Artificial Sequence
  Representative linear modulating agent based on LI-cadherin cell adhesion recognition sequence
YFQINNK

SEQ ID NO: 430 - protein, 8 aa, Artificial Sequence
  Representative linear modulating agent based on LI-cadherin cell adhesion recognition sequence
YFQINNKT

SEQ ID NO: 431 - protein, 9 aa, Artificial Sequence
  Representative linear modulating agent based on LI-cadherin cell adhesion recognition sequence
YFQINNKTG

SEQ ID NO: 432 - protein, 4 aa, Artificial Sequence
  Representative linear modulating agent based on Protocadherin cell adhesion recognition sequence
DLVT

SEQ ID NO: 433 - protein, 5 aa, Artificial Sequence
  Representative linear modulating agent based on Protocadherin cell adhesion recognition sequence
DLVTG

SEQ ID NO: 434 - protein, 4 aa, Artificial Sequence
  Representative linear modulating agent based on Protocadherin cell adhesion recognition sequence
LDLV

SEQ ID NO: 435 - protein, 5 aa, Artificial Sequence
  Representative linear modulating agent based on Protocadherin cell adhesion recognition sequence
LDLVT

SEQ ID NO: 436 - protein, 6 aa, Artificial Sequence
  Representative linear modulating agent based on Protocadherin cell adhesion recognition sequence
LDLVTG

SEQ ID NO: 437 - protein, 5 aa, Artificial Sequence
  Representative linear modulating agent based on Protocadherin cell adhesion recognition sequence
ALDLV

SEQ ID NO: 438 - protein, 6 aa, Artificial Sequence
  Representative linear modulating agent based on Protocadherin cell adhesion recognition sequence
ALDLVT

SEQ ID NO: 439 - protein, 7 aa, Artificial Sequence
  Representative linear modulating agent based on Protocadherin cell adhesion recognition sequence
ALDLVTG

SEQ ID NO: 440 - protein, 6 aa, Artificial Sequence
  Representative linear modulating agent based on Protocadherin cell adhesion recognition sequence
FALDLV

SEQ ID NO: 441 - protein, 7 aa, Artificial Sequence
  Representative linear modulating agent based on Protocadherin cell adhesion recognition sequence
FALDLVT

SEQ ID NO: 442 - protein, 8 aa, Artificial Sequence
  Representative linear modulating agent based on Protocadherin cell adhesion recognition sequence
FALDLVTG

SEQ ID NO: 443 - protein, 7 aa, Artificial Sequence
  Representative linear modulating agent based on Protocadherin cell adhesion recognition sequence
LFALDLV

SEQ ID NO: 444 - protein, 8 aa, Artificial Sequence
  Representative linear modulating agent based on Protocadherin cell adhesion recognition sequence
LFALDLVT

SEQ ID NO: 445 - protein, 9 aa, Artificial Sequence
  Representative linear modulating agent based on Protocadherin cell adhesion recognition sequence
LFALDLVTG

SEQ ID NO: 446 - protein, 4 aa, Artificial Sequence
  Representative linear modulating agent based on Protocadherin cell adhesion recognition sequence
NRDN

SEQ ID NO: 447 - protein, 5 aa, Artificial Sequence
  Representative linear modulating agent based on Protocadherin cell adhesion recognition sequence
NRDNG

SEQ ID NO: 448 - protein, 4 aa, Artificial Sequence
  Representative linear modulating agent based on Protocadherin cell adhesion recognition sequence
INRD

SEQ ID NO: 449 - protein, 5 aa, Artificial Sequence
  Representative linear modulating agent based on Protocadherin cell adhesion recognition sequence
INRDN

SEQ ID NO: 450 - protein, 6 aa, Artificial Sequence
  Representative linear modulating agent based on Protocadherin cell adhesion recognition sequence
INRDNG

SEQ ID NO: 451 - protein, 5 aa, Artificial Sequence
  Representative linear modulating agent based on Protocadherin cell adhesion recognition sequence
TINRD

SEQ ID NO: 452 - protein, 6 aa, Artificial Sequence
  Representative linear modulating agent based on Protocadherin cell adhesion recognition sequence
TINRDN

SEQ ID NO: 453 - protein, 7 aa, Artificial Sequence
  Representative linear modulating agent based on Protocadherin cell adhesion recognition sequence
TINRDNG

SEQ ID NO: 454 - protein, 6 aa, Artificial Sequence
  Representative linear modulating agent based on Protocadherin cell adhesion recognition sequence
FTINRD

SEQ ID NO: 455 - protein, 7 aa, Artificial Sequence
  Representative linear modulating agent based on Protocadherin cell adhesion recognition sequence
FTINRDN

SEQ ID NO: 456 - protein, 8 aa, Artificial Sequence
  Representative linear modulating agent based on Protocadherin cell adhesion recognition sequence
FTINRDNG

SEQ ID NO: 457 - protein, 7 aa, Artificial Sequence
  Representative linear modulating agent based on Protocadherin cell adhesion recognition sequence
YFTINRD

SEQ ID NO: 458 - protein, 8 aa, Artificial Sequence
  Representative linear modulating agent based on Protocadherin cell adhesion recognition sequence
YFTINRDN

SEQ ID NO: 459 - protein, 9 aa, Artificial Sequence
  Representative linear modulating agent based on Protocadherin cell adhesion recognition sequence
YFTINRDNG

SEQ ID NO: 460 - protein, 4 aa, Artificial Sequence
  Representative linear modulating agent based on Protocadherin cell adhesion recognition sequence
DPKT

SEQ ID NO: 461 - protein, 5 aa, Artificial Sequence
  Representative linear modulating agent based on Protocadherin cell adhesion recognition sequence
DPKTG

SEQ ID NO: 462 - protein, 4 aa, Artificial Sequence
  Representative linear modulating agent based on Protocadherin cell adhesion recognition sequence
IDPK

SEQ ID NO: 463 - protein, 5 aa, Artificial Sequence
  Representative linear modulating agent based on Protocadherin cell adhesion recognition sequence
IDPKT

SEQ ID NO: 464 - protein, 6 aa, Artificial Sequence
  Representative linear modulating agent based on Protocadherin cell adhesion recognition sequence
IDPKTG

SEQ ID NO: 465 - protein, 5 aa, Artificial Sequence
  Representative linear modulating agent based on Protocadherin cell adhesion recognition sequence
SIDPK

SEQ ID NO: 466 - protein, 6 aa, Artificial Sequence
  Representative linear modulating agent based on Protocadherin cell adhesion recognition sequence
SIDPKT

SEQ ID NO: 467 - protein, 7 aa, Artificial Sequence
  Representative linear modulating agent based on Protocadherin cell adhesion recognition sequence
SIDPKTG

SEQ ID NO: 468 - protein, 6 aa, Artificial Sequence
  Representative linear modulating agent based on Protocadherin cell adhesion recognition sequence
FSIDPK

SEQ ID NO: 469 - protein, 7 aa, Artificial Sequence
  Representative linear modulating agent based on Protocadherin cell adhesion recognition sequence
FSIDPKT

SEQ ID NO: 470 - protein, 8 aa, Artificial Sequence
  Representative linear modulating agent based on Protocadherin cell adhesion recognition sequence
FSIDPKTG

SEQ ID NO: 471 - protein, 7 aa, Artificial Sequence
  Representative linear modulating agent based on Protocadherin cell adhesion recognition sequence
LFSIDPK

SEQ ID NO: 472 - protein, 8 aa, Artificial Sequence
  Representative linear modulating agent based on Protocadherin cell adhesion recognition sequence
LFSIDPKT

SEQ ID NO: 473 - protein, 9 aa, Artificial Sequence
  Representative linear modulating agent based on Protocadherin cell adhesion recognition sequence
LFSIDPKTG

SEQ ID NO: 474 - protein, 4 aa, Artificial Sequence
  Representative linear modulating agent based on Protocadherin cell adhesion recognition sequence
DPSS

SEQ ID NO: 475 - protein, 5 aa, Artificial Sequence
  Representative linear modulating agent based on Protocadherin cell adhesion recognition sequence
DPSSG

SEQ ID NO: 476 - protein, 4 aa, Artificial Sequence
  Representative linear modulating agent based on Protocadherin cell adhesion recognition sequence
IDPS

SEQ ID NO: 477 - protein, 5 aa, Artificial Sequence
  Representative linear modulating agent based on Protocadherin cell adhesion recognition sequence
IDPSS

SEQ ID NO: 478 - protein, 6 aa, Artificial Sequence
  Representative linear modulating agent based on Protocadherin cell adhesion recognition sequence
IDPSSG

SEQ ID NO: 479 - protein, 5 aa, Artificial Sequence
  Representative linear modulating agent based on Protocadherin cell adhesion recognition sequence
EIDPS

SEQ ID NO: 480 - protein, 6 aa, Artificial Sequence
  Representative linear modulating agent based on Protocadherin cell adhesion recognition sequence
EIDPSS

SEQ ID NO: 481 - protein, 7 aa, Artificial Sequence
  Representative linear modulating agent based on Protocadherin cell adhesion recognition sequence
EIDPSSG

SEQ ID NO: 482 - protein, 6 aa, Artificial Sequence
  Representative linear modulating agent based on Protocadherin cell adhesion recognition sequence
FEIDPS

SEQ ID NO: 483 - protein, 7 aa, Artificial Sequence
  Representative linear modulating agent based on Protocadherin cell adhesion recognition sequence
FEIDPSS

SEQ ID NO: 484 - protein, 6 aa, Artificial Sequence
  Representative linear modulating agent based on Protocadherin cell adhesion recognition sequence
FEIDPS

SEQ ID NO: 485 - protein, 7 aa, Artificial Sequence
  Representative linear modulating agent based on Protocadherin cell adhesion recognition sequence
FEIDPSS

SEQ ID NO: 486 - protein, 8 aa, Artificial Sequence
  Representative linear modulating agent based on Protocadherin cell adhesion recognition sequence
FEIDPSSG

SEQ ID NO: 487 - protein, 7 aa, Artificial Sequence
  Representative linear modulating agent based on Protocadherin cell adhesion recognition sequence
LFEIDPS

SEQ ID NO: 488 - protein, 8 aa, Artificial Sequence
  Representative linear modulating agent based on Protocadherin cell adhesion recognition sequence
LFEIDPSS

SEQ ID NO: 489 - protein, 9 aa, Artificial Sequence
  Representative linear modulating agent based on Protocadherin cell adhesion recognition sequence
LFEIDPSSG

SEQ ID NO: 490 - protein, 4 aa, Artificial Sequence
  Representative linear modulating agent based on Desomglein cell adhesion recognition sequence
NQKT

SEQ ID NO: 491 - protein, 5 aa, Artificial Sequence
  Representative linear modulating agent based on Desomglein cell adhesion recognition sequence
NQKTG

SEQ ID NO: 492 - protein, 4 aa, Artificial Sequence
  Representative linear modulating agent based on Desomglein cell adhesion recognition sequence
INQK

SEQ ID NO: 493 - protein, 5 aa, Artificial Sequence
  Representative linear modulating agent based on Desomglein cell adhesion recognition sequence
INQKT

SEQ ID NO: 494 - protein, 6 aa, Artificial Sequence
  Representative linear modulating agent based on Desomglein cell adhesion recognition sequence
INQKTG

SEQ ID NO: 495 - protein, 5 aa, Artificial Sequence
  Representative linear modulating agent based on Desomglein cell adhesion recognition sequence
VINQK

SEQ ID NO: 496 - protein, 6 aa, Artificial Sequence
  Representative linear modulating agent based on Desomglein cell adhesion recognition sequence
VINQKT

SEQ ID NO: 497 - protein, 7 aa, Artificial Sequence
  Representative linear modulating agent based on Desomglein cell adhesion recognition sequence
VINQKTG

SEQ ID NO: 498 - protein, 6 aa, Artificial Sequence
  Representative linear modulating agent based on Desomglein cell adhesion recognition sequence
FVINQK

SEQ ID NO: 499 - protein, 7 aa, Artificial Sequence
  Representative linear modulating agent based on Desomglein cell adhesion recognition sequence
FVINQKT

SEQ ID NO: 500 - protein, 8 aa, Artificial Sequence
  Representative linear modulating agent based on Desomglein cell adhesion recognition sequence
FVINQKTG

SEQ ID NO: 501 - protein, 7 aa, Artificial Sequence
  Representative linear modulating agent based on Desomglein cell adhesion recognition sequence
IFVINQK

SEQ ID NO: 502 - protein, 8 aa, Artificial Sequence
  Representative linear modulating agent based on Desomglein cell adhesion recognition sequence
IFVINQKT

SEQ ID NO: 503 - protein, 9 aa, Artificial Sequence
  Representative linear modulating agent based on Desomglein cell adhesion recognition sequence
IFVINQKTG

SEQ ID NO: 504 - protein, 4 aa, Artificial Sequence
  Representative linear modulating agent based on Desomglein cell adhesion recognition sequence
NRNT

SEQ ID NO: 505 - protein, 5 aa, Artificial Sequence
  Representative linear modulating agent based on Desomglein cell adhesion recognition sequence
NRNTG

SEQ ID NO: 506 - protein, 4 aa, Artificial Sequence
  Representative linear modulating agent based on Desomglein cell adhesion recognition sequence
INRN

SEQ ID NO: 507 - protein, 5 aa, Artificial Sequence
  Representative linear modulating agent based on Desomglein cell adhesion recognition sequence
INRNT

SEQ ID NO: 508 - protein, 6 aa, Artificial Sequence
  Representative linear modulating agent based on Desomglein cell adhesion recognition sequence
INRNTG

SEQ ID NO: 509 - protein, 5 aa, Artificial Sequence
  Representative linear modulating agent based on Desomglein cell adhesion recognition sequence
IINRN

SEQ ID NO: 510 - protein, 6 aa, Artificial Sequence
  Representative linear modulating agent based on Desomglein cell adhesion recognition sequence
IINRNT

SEQ ID NO: 511 - protein, 7 aa, Artificial Sequence
  Representative linear modulating agent based on Desomglein cell adhesion recognition sequence
IINRNTG

SEQ ID NO: 512 - protein, 6 aa, Artificial Sequence
  Representative linear modulating agent based on Desomglein cell adhesion recognition sequence
FIINRN

SEQ ID NO: 513 - protein, 7 aa, Artificial Sequence
  Representative linear modulating agent based on Desomglein cell adhesion recognition sequence
FIINRNT

SEQ ID NO: 514 - protein, 8 aa, Artificial Sequence
  Representative linear modulating agent based on Desomglein cell adhesion recognition sequence
FIINRNTG

SEQ ID NO: 515 - protein, 7 aa, Artificial Sequence
  Representative linear modulating agent based on Desomglein cell adhesion recognition sequence
MFIINRN

SEQ ID NO: 516 - protein, 8 aa, Artificial Sequence
  Representative linear modulating agent based on Desomglein cell adhesion recognition sequence
MFIINRNT

SEQ ID NO: 517 - protein, 9 aa, Artificial Sequence
  Representative linear modulating agent based on Desomglein cell adhesion recognition sequence
MFIINRNTG

SEQ ID NO: 518 - protein, 4 aa, Artificial Sequence
  Representative linear modulating agent based on Desomglein cell adhesion recognition sequence
NKDT

SEQ ID NO: 519 - protein, 5 aa, Artificial Sequence
  Representative linear modulating agent based on Desomglein cell adhesion recognition sequence
NKDTG

SEQ ID NO: 520 - protein, 4 aa, Artificial Sequence
  Representative linear modulating agent based on Desomglein cell adhesion recognition sequence
LNKD

SEQ ID NO: 521 - protein, 5 aa, Artificial Sequence
  Representative linear modulating agent based on Desomglein cell adhesion recognition sequence
LNKDT

SEQ ID NO: 522 - protein, 6 aa, Artificial Sequence
  Representative linear modulating agent based on Desomglein cell adhesion recognition sequence
LNKDTG

SEQ ID NO: 523 - protein, 5 aa, Artificial Sequence
  Representative linear modulating agent based on Desomglein cell adhesion recognition sequence
YLNKD

SEQ ID NO: 524 - protein, 6 aa, Artificial Sequence
  Representative linear modulating agent based on Desomglein cell adhesion recognition sequence
YLNKDT

SEQ ID NO: 525 - protein, 7 aa, Artificial Sequence
  Representative linear modulating agent based on Desomglein cell adhesion recognition sequence
YLNKDTG

SEQ ID NO: 526 - protein, 6 aa, Artificial Sequence
  Representative linear modulating agent based on Desomglein cell adhesion recognition sequence
FYLNKD

SEQ ID NO: 527 - protein, 7 aa, Artificial Sequence
  Representative linear modulating agent based on Desomglein cell adhesion recognition sequence
FYLNKDT

SEQ ID NO: 528 - protein, 8 aa, Artificial Sequence
  Representative linear modulating agent based on Desomglein cell adhesion recognition sequence
FYLNKDTG

SEQ ID NO: 529 - protein, 7 aa, Artificial Sequence
  Representative linear modulating agent based on Desomglein cell adhesion recognition sequence
VFYLNKD

SEQ ID NO: 530 - protein, 8 aa, Artificial Sequence
  Representative linear modulating agent based on Desomglein cell adhesion recognition sequence
VFYLNKDT

SEQ ID NO: 531 - protein, 9 aa, Artificial Sequence
  Representative linear modulating agent based on Desomglein cell adhesion recognition sequence
VFYLNKDTG

SEQ ID NO: 532 - protein, 4 aa, Artificial Sequence
  Representative linear modulating agent based on Desmocollin cell adhesion recognition sequence
EKDT

SEQ ID NO: 533 - protein, 5 aa, Artificial Sequence
  Representative linear modulating agent based on Desmocollin cell adhesion recognition sequence
EKDTG

SEQ ID NO: 534 - protein, 4 aa, Artificial Sequence
  Representative linear modulating agent based on Desmocollin cell adhesion recognition sequence
IEKD

SEQ ID NO: 535 - protein, 5 aa, Artificial Sequence
  Representative linear modulating agent based on Desmocollin cell adhesion recognition sequence
IEKDT

SEQ ID NO: 536 - protein, 6 aa, Artificial Sequence
  Representative linear modulating agent based on Desmocollin cell adhesion recognition sequence
IEKDTG

SEQ ID NO: 537 - protein, 5 aa, Artificial Sequence
  Representative linear modulating agent based on Desmocollin cell adhesion recognition sequence
YIEKD

SEQ ID NO: 538 - protein, 6 aa, Artificial Sequence
  Representative linear modulating agent based on Desmocollin cell adhesion recognition sequence
YIEKDT

SEQ ID NO: 539 - protein, 7 aa, Artificial Sequence
  Representative linear modulating agent based on Desmocollin cell adhesion recognition sequence
YIEKDTG

SEQ ID NO: 540 - protein, 6 aa, Artificial Sequence
  Representative linear modulating agent based on Desmocollin cell adhesion recognition sequence
FYIEKD

SEQ ID NO: 541 - protein, 7 aa, Artificial Sequence
  Representative linear modulating agent based on Desmocollin cell adhesion recognition sequence
FYIEKDT

SEQ ID NO: 542 - protein, 8 aa, Artificial Sequence
  Representative linear modulating agent based on Desmocollin cell adhesion recognition sequence
FYIEKDTG

SEQ ID NO: 543 - protein, 7 aa, Artificial Sequence
  Representative linear modulating agent based on Desmocollin cell adhesion recognition sequence
LFYIEKD

SEQ ID NO: 544 - protein, 8 aa, Artificial Sequence
  Representative linear modulating agent based on Desmocollin cell adhesion recognition sequence
LFYIEKDT

SEQ ID NO: 545 - protein, 9 aa, Artificial Sequence
  Representative linear modulating agent based on Desmocollin cell adhesion recognition sequence
LFYIEKDTG

SEQ ID NO: 546 - protein, 4 aa, Artificial Sequence
  Representative linear modulating agent based on Desmocollin cell adhesion recognition sequence
ERDT

SEQ ID NO: 547 - protein, 5 aa, Artificial Sequence
  Representative linear modulating agent based on Desmocollin cell adhesion recognition sequence
ERDTG

SEQ ID NO: 548 - protein, 4 aa, Artificial Sequence
  Representative linear modulating agent based on Desmocollin cell adhesion recognition sequence
VERD

SEQ ID NO: 549 - protein, 5 aa, Artificial Sequence
  Representative linear modulating agent based on Desmocollin cell adhesion recognition sequence
VERDT

SEQ ID NO: 550 - protein, 6 aa, Artificial Sequence
  Representative linear modulating agent based on Desmocollin cell adhesion recognition sequence
VERDTG

SEQ ID NO: 551 - protein, 5 aa, Artificial Sequence
  Representative linear modulating agent based on Desmocollin cell adhesion recognition sequence
YVERD

SEQ ID NO: 552 - protein, 6 aa, Artificial Sequence
  Representative linear modulating agent based on Desmocollin cell adhesion recognition sequence
YVERDT

SEQ ID NO: 553 - protein, 7 aa, Artificial Sequence
  Representative linear modulating agent based on Desmocollin cell adhesion recognition sequence
YVERDTG

SEQ ID NO: 554 - protein, 6 aa, Artificial Sequence
  Representative linear modulating agent based on Desmocollin cell adhesion recognition sequence
FYVERD

SEQ ID NO: 555 - protein, 7 aa, Artificial Sequence
  Representative linear modulating agent based on Desmocollin cell adhesion recognition sequence
FYVERDT

SEQ ID NO: 556 - protein, 8 aa, Artificial Sequence
  Representative linear modulating agent based on Desmocollin cell adhesion recognition sequence
FYVERDTG

SEQ ID NO: 557 - protein, 7 aa, Artificial Sequence
  Representative linear modulating agent based on Desmocollin cell adhesion recognition sequence
LFYVERD

SEQ ID NO: 558 - protein, 8 aa, Artificial Sequence
  Representative linear modulating agent based on Desmocollin cell adhesion recognition sequence
LFYVERDT

SEQ ID NO: 559 - protein, 9 aa, Artificial Sequence
  Representative linear modulating agent based on Desmocollin cell adhesion recognition sequence
LFYVERDTG

SEQ ID NO: 560 - protein, 4 aa, Artificial Sequence
  Representative linear modulating agent based on Desmocollin cell adhesion recognition sequence
IERD

SEQ ID NO: 561 - protein, 5 aa, Artificial Sequence
  Representative linear modulating agent based on Desmocollin cell adhesion recognition sequence
IERDT

SEQ ID NO: 562 - protein, 6 aa, Artificial Sequence
  Representative linear modulating agent based on Desmocollin cell adhesion recognition sequence
IERDTG

SEQ ID NO: 563 - protein, 5 aa, Artificial Sequence
  Representative linear modulating agent based on Desmocollin cell adhesion recognition sequence
YIERD

SEQ ID NO: 564 - protein, 6 aa, Artificial Sequence
  Representative linear modulating agent based on Desmocollin cell adhesion recognition sequence
YIERDT

SEQ ID NO: 565 - protein, 7 aa, Artificial Sequence
  Representative linear modulating agent based on Desmocollin cell adhesion recognition sequence
YIERDTG

SEQ ID NO: 566 - protein, 6 aa, Artificial Sequence
  Representative linear modulating agent based on Desmocollin cell adhesion recognition sequence
FYIERD

SEQ ID NO: 567 - protein, 7 aa, Artificial Sequence
  Representative linear modulating agent based on Desmocollin cell adhesion recognition sequence
FYIERDT

SEQ ID NO: 568 - protein, 8 aa, Artificial Sequence
  Representative linear modulating agent based on Desmocollin cell adhesion recognition sequence
FYIERDTG

SEQ ID NO: 569 - protein, 7 aa, Artificial Sequence
  Representative linear modulating agent based on Desmocollin cell adhesion recognition sequence
LFYIERD

SEQ ID NO: 570 - protein, 8 aa, Artificial Sequence
  Representative linear modulating agent based on Desmocollin cell adhesion recognition sequence
LFYIERDT

SEQ ID NO: 571 - protein, 9 aa, Artificial Sequence
  Representative linear modulating agent based on Desmocollin cell adhesion recognition sequence
LFYIERDTG

SEQ ID NO: 572 - protein, 4 aa, Artificial Sequence
  Representative linear modulating agent based on cadherin-related neuronal receptor cell adhesion recognition sequence
DPVS

SEQ ID NO: 573 - protein, 5 aa, Artificial Sequence
  Representative linear modulating agent based on cadherin-related neuronal receptor cell adhesion recognition sequence
DPVSG

SEQ ID NO: 574 - protein, 4 aa, Artificial Sequence
  Representative linear modulating agent based on cadherin-related neuronal receptor cell adhesion recognition sequence
IDPV

SEQ ID NO: 575 - protein, 5 aa, Artificial Sequence
  Representative linear modulating agent based on cadherin-related neuronal receptor cell adhesion recognition sequence
IDPVS

SEQ ID NO: 576 - protein, 6 aa, Artificial Sequence
  Representative linear modulating agent based on cadherin-related neuronal receptor cell adhesion recognition sequence
IDPVSG

SEQ ID NO: 577 - protein, 5 aa, Artificial Sequence
  Representative linear modulating agent based on cadherin-related neuronal receptor cell adhesion recognition sequence
HIDPV

SEQ ID NO: 578 - protein, 6 aa, Artificial Sequence
  Representative linear modulating agent based on cadherin-related neuronal receptor cell adhesion recognition sequence
HIDPVS

SEQ ID NO: 579 - protein, 7 aa, Artificial Sequence
  Representative linear modulating agent based on cadherin-related neuronal receptor cell adhesion recognition sequence
HIDPVSG

SEQ ID NO: 580 - protein, 6 aa, Artificial Sequence
  Representative linear modulating agent based on cadherin-related neuronal receptor cell adhesion recognition sequence
FHIDPV

SEQ ID NO: 581 - protein, 7 aa, Artificial Sequence
  Representative linear modulating agent based on cadherin-related neuronal receptor cell adhesion recognition sequence
FHIDPVS

SEQ ID NO: 582 - protein, 8 aa, Artificial Sequence
  Representative linear modulating agent based on cadherin-related neuronal receptor cell adhesion recognition sequence
FHIDPVSG

SEQ ID NO: 583 - protein, 7 aa, Artificial Sequence
  Representative linear modulating agent based on cadherin-related neuronal receptor cell adhesion recognition sequence
KFHIDPV

SEQ ID NO: 584 - protein, 8 aa, Artificial Sequence
  Representative linear modulating agent based on cadherin-related neuronal receptor cell adhesion recognition sequence
KFHIDPVS

SEQ ID NO: 585 - protein, 9 aa, Artificial Sequence
  Representative linear modulating agent based on cadherin-related neuronal receptor cell adhesion recognition sequence
KFHIDPVSG

SEQ ID NO: 586 - protein, 4 aa, Artificial Sequence
  Representative linear modulating agent based on cadherin-related neuronal receptor cell adhesion recognition sequence
DADT

SEQ ID NO: 587 - protein, 5 aa, Artificial Sequence
  Representative linear modulating agent based on cadherin-related neuronal receptor cell adhesion recognition sequence
DADTG

SEQ ID NO: 588 - protein, 4 aa, Artificial Sequence
  Representative linear modulating agent based on cadherin-related neuronal receptor cell adhesion recognition sequence
IDAD

SEQ ID NO: 589 - protein, 5 aa, Artificial Sequence
  Representative linear modulating agent based on cadherin-related neuronal receptor cell adhesion recognition sequence
IDADT

SEQ ID NO: 590 - protein, 6 aa, Artificial Sequence
  Representative linear modulating agent based on cadherin-related neuronal receptor cell adhesion recognition sequence
IDADTG

SEQ ID NO: 591 - protein, 5 aa, Artificial Sequence
  Representative linear modulating agent based on cadherin-related neuronal receptor cell adhesion recognition sequence
SIDAD

SEQ ID NO: 592 - protein, 6 aa, Artificial Sequence
  Representative linear modulating agent based on cadherin-related neuronal receptor cell adhesion recognition sequence
SIDADT

SEQ ID NO: 593 - protein, 7 aa, Artificial Sequence
  Representative linear modulating agent based on cadherin-related neuronal receptor cell adhesion recognition sequence
SIDADTG

SEQ ID NO: 594 - protein, 6 aa, Artificial Sequence
  Representative linear modulating agent based on cadherin-related neuronal receptor cell adhesion recognition sequence
FSIDAD

SEQ ID NO: 595 - protein, 7 aa, Artificial Sequence
  Representative linear modulating agent based on cadherin-related neuronal receptor cell adhesion recognition sequence
FSIDADT

SEQ ID NO: 596 - protein, 8 aa, Artificial Sequence
  Representative linear modulating agent based on cadherin-related neuronal receptor cell adhesion recognition sequence
FSIDADTG

SEQ ID NO: 597 - protein, 7 aa, Artificial Sequence
  Representative linear modulating agent based on cadherin-related neuronal receptor cell adhesion recognition sequence
QFSIDAD

SEQ ID NO: 598 - protein, 8 aa, Artificial Sequence
  Representative linear modulating agent based on cadherin-related neuronal receptor cell adhesion recognition sequence
QFSIDADT

SEQ ID NO: 599 - protein, 9 aa, Artificial Sequence
  Representative linear modulating agent based on cadherin-related neuronal receptor cell adhesion recognition sequence
QFSIDADTG

SEQ ID NO: 600 - protein, 4 aa, Artificial Sequence
  Representative linear modulating agent based on cadherin-related neuronal receptor cell adhesion recognition sequence
DSVS

SEQ ID NO: 601 - protein, 5 aa, Artificial Sequence
  Representative linear modulating agent based on cadherin-related neuronal receptor cell adhesion recognition sequence
DSVSG

SEQ ID NO: 602 - protein, 4 aa, Artificial Sequence
  Representative linear modulating agent based on cadherin-related neuronal receptor cell adhesion recognition sequence
IDSV

SEQ ID NO: 603 - protein, 5 aa, Artificial Sequence
  Representative linear modulating agent based on cadherin-related neuronal receptor cell adhesion recognition sequence
IDSVS

SEQ ID NO: 604 - protein, 6 aa, Artificial Sequence
  Representative linear modulating agent based on cadherin-related neuronal receptor cell adhesion recognition sequence
IDSVSG

SEQ ID NO: 605 - protein, 5 aa, Artificial Sequence
  Representative linear modulating agent based on cadherin-related neuronal receptor cell adhesion recognition sequence
HIDSV

SEQ ID NO: 606 - protein, 6 aa, Artificial Sequence
  Representative linear modulating agent based on cadherin-related neuronal receptor cell adhesion recognition sequence
HIDSVS

SEQ ID NO: 607 - protein, 7 aa, Artificial Sequence
  Representative linear modulating agent based on cadherin-related neuronal receptor cell adhesion recognition sequence
HIDSVSG

SEQ ID NO: 608 - protein, 6 aa, Artificial Sequence
  Representative linear modulating agent based on cadherin-related neuronal receptor cell adhesion recognition sequence
FHIDSV

SEQ ID NO: 609 - protein, 7 aa, Artificial Sequence
  Representative linear modulating agent based on cadherin-related neuronal receptor cell adhesion recognition sequence
FHIDSVS

SEQ ID NO: 610 - protein, 8 aa, Artificial Sequence
  Representative linear modulating agent based on cadherin-related neuronal receptor cell adhesion recognition sequence
FHIDSVSG

SEQ ID NO: 611 - protein, 7 aa, Artificial Sequence
  Representative linear modulating agent based on cadherin-related neuronal receptor cell adhesion recognition sequence
TFHIDSV

SEQ ID NO: 612 - protein, 8 aa, Artificial Sequence
  Representative linear modulating agent based on cadherin-related neuronal receptor cell adhesion recognition sequence
TFHIDSVS

SEQ ID NO: 613 - protein, 9 aa, Artificial Sequence
  Representative linear modulating agent based on cadherin-related neuronal receptor cell adhesion recognition sequence
TFHIDSVSG

SEQ ID NO: 614 - protein, 4 aa, Artificial Sequence
  Representative linear modulating agent based on cadherin-related neuronal receptor cell adhesion recognition sequence
DSNS

SEQ ID NO: 615 - protein, 5 aa, Artificial Sequence
  Representative linear modulating agent based on cadherin-related neuronal receptor cell adhesion recognition sequence
DSNSG

SEQ ID NO: 616 - protein, 4 aa, Artificial Sequence
  Representative linear modulating agent based on cadherin-related neuronal receptor cell adhesion recognition sequence
IDSN

SEQ ID NO: 617 - protein, 5 aa, Artificial Sequence
  Representative linear modulating agent based on cadherin-related neuronal receptor cell adhesion recognition sequence
IDSNS

SEQ ID NO: 618 - protein, 6 aa, Artificial Sequence
  Representative linear modulating agent based on cadherin-related neuronal receptor cell adhesion recognition sequence
IDSNSG

SEQ ID NO: 619 - protein, 5 aa, Artificial Sequence
  Representative linear modulating agent based on cadherin-related neuronal receptor cell adhesion recognition sequence
NIDSN

SEQ ID NO: 620 - protein, 6 aa, Artificial Sequence
  Representative linear modulating agent based on cadherin-related neuronal receptor cell adhesion recognition sequence
NIDSNS

SEQ ID NO: 621 - protein, 7 aa, Artificial Sequence
  Representative linear modulating agent based on cadherin-related neuronal receptor cell adhesion recognition sequence
NIDSNSG

SEQ ID NO: 622 - protein, 6 aa, Artificial Sequence
  Representative linear modulating agent based on cadherin-related neuronal receptor cell adhesion recognition sequence
FNIDSN

SEQ ID NO: 623 - protein, 7 aa, Artificial Sequence
  Representative linear modulating agent based on cadherin-related neuronal receptor cell adhesion recognition sequence
FNIDSNS

SEQ ID NO: 624 - protein, 8 aa, Artificial Sequence
  Representative linear modulating agent based on cadherin-related neuronal receptor cell adhesion recognition sequence
FNIDSNSG

SEQ ID NO: 625 - protein, 7 aa, Artificial Sequence
  Representative linear modulating agent based on cadherin-related neuronal receptor cell adhesion recognition sequence
AFNIDSN

SEQ ID NO: 626 - protein, 8 aa, Artificial Sequence
  Representative linear modulating agent based on cadherin-related neuronal receptor cell adhesion recognition sequence
AFNIDSNS

SEQ ID NO: 627 - protein, 9 aa, Artificial Sequence
  Representative linear modulating agent based on cadherin-related neuronal receptor cell adhesion recognition sequence
AFNIDSNSG

SEQ ID NO: 628 - protein, 4 aa, Artificial Sequence
  Representative linear modulating agent based on cadherin-related neuronal receptor cell adhesion recognition sequence
DSSS

SEQ ID NO: 629 - protein, 5 aa, Artificial Sequence
  Representative linear modulating agent based on cadherin-related neuronal receptor cell adhesion recognition sequence
DSSSG

SEQ ID NO: 630 - protein, 4 aa, Artificial Sequence
  Representative linear modulating agent based on cadherin-related neuronal receptor cell adhesion recognition sequence
IDSS

SEQ ID NO: 631 - protein, 5 aa, Artificial Sequence
  Representative linear modulating agent based on cadherin-related neuronal receptor cell adhesion recognition sequence
IDSSS

SEQ ID NO: 632 - protein, 6 aa, Artificial Sequence
  Representative linear modulating agent based on cadherin-related neuronal receptor cell adhesion recognition sequence
IDSSSG

SEQ ID NO: 633 - protein, 5 aa, Artificial Sequence
  Representative linear modulating agent based on cadherin-related neuronal receptor cell adhesion recognition sequence
TIDSS

SEQ ID NO: 634 - protein, 6 aa, Artificial Sequence
  Representative linear modulating agent based on cadherin-related neuronal receptor cell adhesion recognition sequence
TIDSSS

SEQ ID NO: 635 - protein, 7 aa, Artificial Sequence
  Representative linear modulating agent based on cadherin-related neuronal receptor cell adhesion recognition sequence
TIDSSSG

SEQ ID NO: 636 - protein, 6 aa, Artificial Sequence
  Representative linear modulating agent based on cadherin-related neuronal receptor cell adhesion recognition sequence
FTIDSS

SEQ ID NO: 637 - protein, 7 aa, Artificial Sequence
  Representative linear modulating agent based on cadherin-related neuronal receptor cell adhesion recognition sequence
FTIDSSS

SEQ ID NO: 638 - protein, 8 aa, Artificial Sequence
  Representative linear modulating agent based on cadherin-related neuronal receptor cell adhesion recognition sequence
FTIDSSSG

SEQ ID NO: 639 - protein, 7 aa, Artificial Sequence
  Representative linear modulating agent based on cadherin-related neuronal receptor cell adhesion recognition sequence
KFTIDSS

SEQ ID NO: 640 - protein, 8 aa, Artificial Sequence
  Representative linear modulating agent based on cadherin-related neuronal receptor cell adhesion recognition sequence
KFTIDSSS

SEQ ID NO: 641 - protein, 9 aa, Artificial Sequence
  Representative linear modulating agent based on cadherin-related neuronal receptor cell adhesion recognition sequence
KFTIDSSSG

SEQ ID NO: 642 - protein, 4 aa, Artificial Sequence
  Representative linear modulating agent based on cadherin-related neuronal receptor cell adhesion recognition sequence
DEKN

SEQ ID NO: 643 - protein, 5 aa, Artificial Sequence
  Representative linear modulating agent based on cadherin-related neuronal receptor cell adhesion recognition sequence
DEKNG

SEQ ID NO: 644 - protein, 4 aa, Artificial Sequence
  Representative linear modulating agent based on cadherin-related neuronal receptor cell adhesion recognition sequence
LDEK

SEQ ID NO: 645 - protein, 5 aa, Artificial Sequence
  Representative linear modulating agent based on cadherin-related neuronal receptor cell adhesion recognition sequence
LDEKN

SEQ ID NO: 646 - protein, 6 aa, Artificial Sequence
  Representative linear modulating agent based on cadherin-related neuronal receptor cell adhesion recognition sequence
LDEKNG

SEQ ID NO: 647 - protein, 5 aa, Artificial Sequence
  Representative linear modulating agent based on cadherin-related neuronal receptor cell adhesion recognition sequence
TLDEK

SEQ ID NO: 648 - protein, 6 aa, Artificial Sequence
  Representative linear modulating agent based on cadherin-related neuronal receptor cell adhesion recognition sequence
TLDEKN

SEQ ID NO: 649 - protein, 7 aa, Artificial Sequence
  Representative linear modulating agent based on cadherin-related neuronal receptor cell adhesion recognition sequence
TLDEKNG

SEQ ID NO: 650 - protein, 6 aa, Artificial Sequence
  Representative linear modulating agent based on cadherin-related neuronal receptor cell adhesion recognition sequence
FTLDEK

SEQ ID NO: 651 - protein, 7 aa, Artificial Sequence
  Representative linear modulating agent based on cadherin-related neuronal receptor cell adhesion recognition sequence
FTLDEKN

SEQ ID NO: 652 - protein, 8 aa, Artificial Sequence
  Representative linear modulating agent based on cadherin-related neuronal receptor cell adhesion recognition sequence
FTLDEKNG

SEQ ID NO: 653 - protein, 7 aa, Artificial Sequence
  Representative linear modulating agent based on cadherin-related neuronal receptor cell adhesion recognition sequence
LFTLDEK

SEQ ID NO: 654 - protein, 8 aa, Artificial Sequence
  Representative linear modulating agent based on cadherin-related neuronal receptor cell adhesion recognition sequence
LFTLDEKN

SEQ ID NO: 655 - protein, 9 aa, Artificial Sequence
  Representative linear modulating agent based on cadherin-related neuronal receptor cell adhesion recognition sequence
LFTLDEKNG

SEQ ID NO: 656 - protein, 4 aa, Artificial Sequence
  Representative linear modulating agent based on cadherin-related neuronal receptor cell adhesion recognition sequence
NEKT

SEQ ID NO: 657 - protein, 5 aa, Artificial Sequence
  Representative linear modulating agent based on cadherin-related neuronal receptor cell adhesion recognition sequence
NEKTG

SEQ ID NO: 658 - protein, 4 aa, Artificial Sequence
  Representative linear modulating agent based on cadherin-related neuronal receptor cell adhesion recognition sequence
INEK

SEQ ID NO: 659 - protein, 5 aa, Artificial Sequence
  Representative linear modulating agent based on cadherin-related neuronal receptor cell adhesion recognition sequence
INEKT

SEQ ID NO: 660 - protein, 6 aa, Artificial Sequence
  Representative linear modulating agent based on cadherin-related neuronal receptor cell adhesion recognition sequence
INEKTG

SEQ ID NO: 661 - protein, 5 aa, Artificial Sequence
  Representative linear modulating agent based on cadherin-related neuronal receptor cell adhesion recognition sequence
LINEK

SEQ ID NO: 662 - protein, 6 aa, Artificial Sequence
  Representative linear modulating agent based on cadherin-related neuronal receptor cell adhesion recognition sequence
LINEKT

SEQ ID NO: 663 - protein, 7 aa, Artificial Sequence
  Representative linear modulating agent based on cadherin-related neuronal receptor cell adhesion recognition sequence
LINEKTG

SEQ ID NO: 664 - protein, 6 aa, Artificial Sequence
  Representative linear modulating agent based on cadherin-related neuronal receptor cell adhesion recognition sequence
FLINEK

SEQ ID NO: 665 - protein, 7 aa, Artificial Sequence
  Representative linear modulating agent based on cadherin-related neuronal receptor cell adhesion recognition sequence
FLINEKT

SEQ ID NO: 666 - protein, 8 aa, Artificial Sequence
  Representative linear modulating agent based on cadherin-related neuronal receptor cell adhesion recognition sequence
FLINEKTG

SEQ ID NO: 667 - protein, 7 aa, Artificial Sequence
  Representative linear modulating agent based on cadherin-related neuronal receptor cell adhesion recognition sequence
KFLINEK

SEQ ID NO: 668 - protein, 8 aa, Artificial Sequence
  Representative linear modulating agent based on cadherin-related neuronal receptor cell adhesion recognition sequence
KFLINEKT

SEQ ID NO: 669 - protein, 5 aa, Artificial Sequence
  Representative cyclic modulating agent based on OB-cadherin cell adhesion recognition sequence
CDDKC

SEQ ID NO: 670 - protein, 6 aa, Artificial Sequence
  Representative cyclic modulating agent based on OB-cadherin cell adhesion recognition sequence
CIDDKC

SEQ ID NO: 671 - protein, 6 aa, Artificial Sequence
  Representative cyclic modulating agent based on OB-cadherin cell adhesion recognition sequence
CDDKSC

SEQ ID NO: 672 - protein, 7 aa, Artificial Sequence
  Representative cyclic modulating agent based on OB-cadherin cell adhesion recognition sequence
CVIDDKC

SEQ ID NO: 673 - protein, 7 aa, Artificial Sequence
  Representative cyclic modulating agent based on OB-cadherin cell adhesion recognition sequence
CIDDKSC

SEQ ID NO: 674 - protein, 8 aa, Artificial Sequence
  Representative cyclic modulating agent based on OB-cadherin cell adhesion recognition sequence
CVIDDKSC

SEQ ID NO: 675 - protein, 7 aa, Artificial Sequence
  Representative cyclic modulating agent based on OB-cadherin cell adhesion recognition sequence
CDDKSGC

SEQ ID NO: 676 - protein, 8 aa, Artificial Sequence
  Representative cyclic modulating agent based on OB-cadherin cell adhesion recognition sequence
CIDDKSGC

SEQ ID NO: 677 - protein, 9 aa, Artificial Sequence
  Representative cyclic modulating agent based on OB-cadherin cell adhesion recognition sequence
CVIDDKSGC

SEQ ID NO: 678 - protein, 8 aa, Artificial Sequence
  Representative cyclic modulating agent based on OB-cadherin cell adhesion recognition sequence
CFVIDDKC

SEQ ID NO: 679 - protein, 9 aa, Artificial Sequence
  Representative cyclic modulating agent based on OB-cadherin cell adhesion recognition sequence
CFVIDDKSC

SEQ ID NO: 680 - protein, 10 aa, Artificial Sequence
  Representative cyclic modulating agent based on OB-cadherin cell adhesion recognition sequence
CFVIDDKSGC

SEQ ID NO: 681 - protein, 9 aa, Artificial Sequence
  Representative cyclic modulating agent based on OB-cadherin cell adhesion recognition sequence
CIFVIDDKC

SEQ ID NO: 682 - protein, 10 aa, Artificial Sequence
  Representative cyclic modulating agent based on OB-cadherin cell adhesion recognition sequence
CIFVIDDKSC

SEQ ID NO: 683 - protein, 11 aa, Artificial Sequence
  Representative cyclic modulating agent based on OB-cadherin cell adhesion recognition sequence
CIFVIDDKSGC

SEQ ID NO: 684 - protein, 5 aa, Artificial Sequence
  Representative cyclic modulating agent based on OB-cadherin cell adhesion recognition sequence
DDDKK

SEQ ID NO: 685 - protein, 6 aa, Artificial Sequence
  Representative cyclic modulating agent based on OB-cadherin cell adhesion recognition sequence
DIDDKK

SEQ ID NO: 686 - protein, 7 aa, Artificial Sequence
  Representative cyclic modulating agent based on OB-cadherin cell adhesion recognition sequence
DVIDDKK

SEQ ID NO: 687 - protein, 8 aa, Artificial Sequence
  Representative cyclic modulating agent based on OB-cadherin cell adhesion recognition sequence
DFVIDDKK

SEQ ID NO: 688 - protein, 9 aa, Artificial Sequence
  Representative cyclic modulating agent based on OB-cadherin cell adhesion recognition sequence
DIFVIDDKK

SEQ ID NO: 689 - protein, 5 aa, Artificial Sequence
  Representative cyclic modulating agent based on OB-cadherin cell adhesion recognition sequence
EDDKK

SEQ ID NO: 690 - protein, 6 aa, Artificial Sequence
  Representative cyclic modulating agent based on OB-cadherin cell adhesion recognition sequence
EIDDKK

SEQ ID NO: 691 - protein, 7 aa, Artificial Sequence
  Representative cyclic modulating agent based on OB-cadherin cell adhesion recognition sequence
EVIDDKK

SEQ ID NO: 692 - protein, 8 aa, Artificial Sequence
  Representative cyclic modulating agent based on OB-cadherin cell adhesion recognition sequence
EFVIDDKK

SEQ ID NO: 693 - protein, 9 aa, Artificial Sequence
  Representative cyclic modulating agent based on OB-cadherin cell adhesion recognition sequence
EIFVIDDKK

SEQ ID NO: 694 - protein, 6 aa, Artificial Sequence
  Representative cyclic modulating agent based on OB-cadherin cell adhesion recognition sequence
FVIDDK

SEQ ID NO: 695 - protein, 7 aa, Artificial Sequence
  Representative cyclic modulating agent based on OB-cadherin cell adhesion recognition sequence
FVIDDKS

SEQ ID NO: 696 - protein, 8 aa, Artificial Sequence
  Representative cyclic modulating agent based on OB-cadherin cell adhesion recognition sequence
FVIDDKSG

SEQ ID NO: 697 - protein, 5 aa, Artificial Sequence
  Representative cyclic modulating agent based on OB-cadherin cell adhesion recognition sequence
KDDKD

SEQ ID NO: 698 - protein, 6 aa, Artificial Sequence
  Representative cyclic modulating agent based on OB-cadherin cell adhesion recognition sequence
KIDDKD

SEQ ID NO: 699 - protein, 6 aa, Artificial Sequence
  Representative cyclic modulating agent based on OB-cadherin cell adhesion recognition sequence
KDDKSD

SEQ ID NO: 700 - protein, 7 aa, Artificial Sequence
  Representative cyclic modulating agent based on OB-cadherin cell adhesion recognition sequence
KVIDDKD

SEQ ID NO: 701 - protein, 7 aa, Artificial Sequence
  Representative cyclic modulating agent based on OB-cadherin cell adhesion recognition sequence
KIDDKSD

SEQ ID NO: 702 - protein, 8 aa, Artificial Sequence
  Representative cyclic modulating agent based on OB-cadherin cell adhesion recognition sequence
KVIDDKSD

SEQ ID NO: 703 - protein, 7 aa, Artificial Sequence
  Representative cyclic modulating agent based on OB-cadherin cell adhesion recognition sequence
KDDKSGD

SEQ ID NO: 704 - protein, 8 aa, Artificial Sequence
  Representative cyclic modulating agent based on OB-cadherin cell adhesion recognition sequence
KIDDKSGD

SEQ ID NO: 705 - protein, 9 aa, Artificial Sequence
  Representative cyclic modulating agent based on OB-cadherin cell adhesion recognition sequence
KVIDDKSGD

SEQ ID NO: 706 - protein, 8 aa, Artificial Sequence
  Representative cyclic modulating agent based on OB-cadherin cell adhesion recognition sequence
KFVIDDKD

SEQ ID NO: 707 - protein, 9 aa, Artificial Sequence
  Representative cyclic modulating agent based on OB-cadherin cell adhesion recognition sequence
KFVIDDKSD

SEQ ID NO: 708 - protein, 10 aa, Artificial Sequence
  Representative cyclic modulating agent based on OB-cadherin cell adhesion recognition sequence
KFVIDDKSGD

SEQ ID NO: 709 - protein, 9 aa, Artificial Sequence
  Representative cyclic modulating agent based on OB-cadherin cell adhesion recognition sequence
KIFVIDDKD

SEQ ID NO: 710 - protein, 10 aa, Artificial Sequence
  Representative cyclic modulating agent based on OB-cadherin cell adhesion recognition sequence
KIFVIDDKSD

SEQ ID NO: 711 - protein, 11 aa, Artificial Sequence
  Representative cyclic modulating agent based on OB-cadherin cell adhesion recognition sequence
KIFVIDDKSGD

SEQ ID NO: 712 - protein, 5 aa, Artificial Sequence
  Representative cyclic modulating agent based on OB-cadherin cell adhesion recognition sequence
VIDDK

SEQ ID NO: 713 - protein, 5 aa, Artificial Sequence
  Representative cyclic modulating agent based on OB-cadherin cell adhesion recognition sequence
IDDKS

SEQ ID NO: 714 - protein, 6 aa, Artificial Sequence
  Representative cyclic modulating agent based on OB-cadherin cell adhesion recognition sequence
VIDDKS

SEQ ID NO: 715 - protein, 7 aa, Artificial Sequence
  Representative cyclic modulating agent based on OB-cadherin cell adhesion recognition sequence
VIDDKSG

SEQ ID NO: 716 - protein, 5 aa, Artificial Sequence
  Representative cyclic modulating agent based on OB-cadherin cell adhesion recognition sequence
DDKSG

SEQ ID NO: 717 - protein, 6 aa, Artificial Sequence
  Representative cyclic modulating agent based on OB-cadherin cell adhesion recognition sequence
IDDKSG

SEQ ID NO: 718 - protein, 7 aa, Artificial Sequence
  Representative cyclic modulating agent based on OB-cadherin cell adhesion recognition sequence
IFVIDDK

SEQ ID NO: 719 - protein, 8 aa, Artificial Sequence
  Representative cyclic modulating agent based on OB-cadherin cell adhesion recognition sequence
IFVIDDKS

SEQ ID NO: 720 - protein, 9 aa, Artificial Sequence
  Representative cyclic modulating agent based on OB-cadherin cell adhesion recognition sequence
IFVIDDKSG

SEQ ID NO: 721 - protein, 5 aa, Artificial Sequence
  Representative cyclic modulating agent based on OB-cadherin cell adhesion recognition sequence
KDDKE

SEQ ID NO: 722 - protein, 6 aa, Artificial Sequence
  Representative cyclic modulating agent based on OB-cadherin cell adhesion recognition sequence
KIDDKE

SEQ ID NO: 723 - protein, 6 aa, Artificial Sequence
  Representative cyclic modulating agent based on OB-cadherin cell adhesion recognition sequence
KDDKSE

SEQ ID NO: 724 - protein, 7 aa, Artificial Sequence
  Representative cyclic modulating agent based on OB-cadherin cell adhesion recognition sequence
KVIDDKE

SEQ ID NO: 725 - protein, 7 aa, Artificial Sequence
  Representative cyclic modulating agent based on OB-cadherin cell adhesion recognition sequence
KIDDKSE

SEQ ID NO: 726 - protein, 8 aa, Artificial Sequence
  Representative cyclic modulating agent based on OB-cadherin cell adhesion recognition sequence
KVIDDKSE

SEQ ID NO: 727 - protein, 7 aa, Artificial Sequence
  Representative cyclic modulating agent based on OB-cadherin cell adhesion recognition sequence
KDDKSGE

SEQ ID NO: 728 - protein, 8 aa, Artificial Sequence
  Representative cyclic modulating agent based on OB-cadherin cell adhesion recognition sequence
KIDDKSGE

SEQ ID NO: 729 - protein, 9 aa, Artificial Sequence
  Representative cyclic modulating agent based on OB-cadherin cell adhesion recognition sequence
KVIDDKSGE

SEQ ID NO: 730 - protein, 8 aa, Artificial Sequence
  Representative cyclic modulating agent based on OB-cadherin cell adhesion recognition sequence
KFVIDDKE

SEQ ID NO: 731 - protein, 9 aa, Artificial Sequence
  Representative cyclic modulating agent based on OB-cadherin cell adhesion recognition sequence
KFVIDDKSE

SEQ ID NO: 732 - protein, 10 aa, Artificial Sequence
  Representative cyclic modulating agent based on OB-cadherin cell adhesion recognition sequence
KFVIDDKSGE

SEQ ID NO: 733 - protein, 9 aa, Artificial Sequence
  Representative cyclic modulating agent based on OB-cadherin cell adhesion recognition sequence
KIFVIDDKE

SEQ ID NO: 734 - protein, 10 aa, Artificial Sequence
  Representative cyclic modulating agent based on OB-cadherin cell adhesion recognition sequence
KIFVIDDKSE

SEQ ID NO: 735 - protein, 11 aa, Artificial Sequence
  Representative cyclic modulating agent based on OB-cadherin cell adhesion recognition sequence
KIFVIDDKSGE

SEQ ID NO: 736 - protein, 5 aa, Artificial Sequence
  Representative cyclic modulating agent based on OB-cadherin cell adhesion recognition sequence
CEEYC

SEQ ID NO: 737 - protein, 6 aa, Artificial Sequence
  Representative cyclic modulating agent based on OB-cadherin cell adhesion recognition sequence
CIEEYC

SEQ ID NO: 738 - protein, 6 aa, Artificial Sequence
  Representative cyclic modulating agent based on OB-cadherin cell adhesion recognition sequence
CEEYTC

SEQ ID NO: 739 - protein, 7 aa, Artificial Sequence
  Representative cyclic modulating agent based on OB-cadherin cell adhesion recognition sequence
CVIEEYC

SEQ ID NO: 740 - protein, 7 aa, Artificial Sequence
  Representative cyclic modulating agent based on OB-cadherin cell adhesion recognition sequence
CIEEYTC

SEQ ID NO: 741 - protein, 8 aa, Artificial Sequence
  Representative cyclic modulating agent based on OB-cadherin cell adhesion recognition sequence
CVIEEYTC

SEQ ID NO: 742 - protein, 7 aa, Artificial Sequence
  Representative cyclic modulating agent based on OB-cadherin cell adhesion recognition sequence
CEEYTGC

SEQ ID NO: 743 - protein, 8 aa, Artificial Sequence
  Representative cyclic modulating agent based on OB-cadherin cell adhesion recognition sequence
CIEEYTGC

SEQ ID NO: 744 - protein, 9 aa, Artificial Sequence
  Representative cyclic modulating agent based on OB-cadherin cell adhesion recognition sequence
CVIEEYTGC

SEQ ID NO: 745 - protein, 8 aa, Artificial Sequence
  Representative cyclic modulating agent based on OB-cadherin cell adhesion recognition sequence
CFVIEEYC

SEQ ID NO: 746 - protein, 9 aa, Artificial Sequence
  Representative cyclic modulating agent based on OB-cadherin cell adhesion recognition sequence
CFVIEEYTC

SEQ ID NO: 747 - protein, 10 aa, Artificial Sequence
  Representative cyclic modulating agent based on OB-cadherin cell adhesion recognition sequence
CFVIEEYTGC

SEQ ID NO: 748 - protein, 9 aa, Artificial Sequence
  Representative cyclic modulating agent based on OB-cadherin cell adhesion recognition sequence
CFFVIEEYC

SEQ ID NO: 749 - protein, 10 aa, Artificial Sequence
  Representative cyclic modulating agent based on OB-cadherin cell adhesion recognition sequence
CFFVIEEYTC

SEQ ID NO: 750 - protein, 11 aa, Artificial Sequence
  Representative cyclic modulating agent based on OB-cadherin cell adhesion recognition sequence
CFFVIEEYTGC

SEQ ID NO: 751 - protein, 5 aa, Artificial Sequence
  Representative cyclic modulating agent based on OB-cadherin cell adhesion recognition sequence
KEEYD

SEQ ID NO: 752 - protein, 6 aa, Artificial Sequence
  Representative cyclic modulating agent based on OB-cadherin cell adhesion recognition sequence
KIEEYD

SEQ ID NO: 753 - protein, 6 aa, Artificial Sequence
  Representative cyclic modulating agent based on OB-cadherin cell adhesion recognition sequence
KEEYTD

SEQ ID NO: 754 - protein, 7 aa, Artificial Sequence
  Representative cyclic modulating agent based on OB-cadherin cell adhesion recognition sequence
KVIEEYD

SEQ ID NO: 755 - protein, 7 aa, Artificial Sequence
  Representative cyclic modulating agent based on OB-cadherin cell adhesion recognition sequence
KIEEYTD

SEQ ID NO: 756 - protein, 8 aa, Artificial Sequence
  Representative cyclic modulating agent based on OB-cadherin cell adhesion recognition sequence
KVIEEYTD

SEQ ID NO: 757 - protein, 8 aa, Artificial Sequence
  Representative cyclic modulating agent based on OB-cadherin cell adhesion recognition sequence
KEEYTGCD

SEQ ID NO: 758 - protein, 8 aa, Artificial Sequence
  Representative cyclic modulating agent based on OB-cadherin cell adhesion recognition sequence
KIEEYTGD

SEQ ID NO: 759 - protein, 9 aa, Artificial Sequence
  Representative cyclic modulating agent based on OB-cadherin cell adhesion recognition sequence
KVIEEYTGD

SEQ ID NO: 760 - protein, 8 aa, Artificial Sequence
  Representative cyclic modulating agent based on OB-cadherin cell adhesion recognition sequence
KFVIEEYD

SEQ ID NO: 761 - protein, 9 aa, Artificial Sequence
  Representative cyclic modulating agent based on OB-cadherin cell adhesion recognition sequence
KFVIEEYTD

SEQ ID NO: 762 - protein, 10 aa, Artificial Sequence
  Representative cyclic modulating agent based on OB-cadherin cell adhesion recognition sequence
KFVIEEYTGD

SEQ ID NO: 763 - protein, 9 aa, Artificial Sequence
  Representative cyclic modulating agent based on OB-cadherin cell adhesion recognition sequence
KFFVIEEYD

SEQ ID NO: 764 - protein, 10 aa, Artificial Sequence
  Representative cyclic modulating agent based on OB-cadherin cell adhesion recognition sequence
KFFVIEEYTD

SEQ ID NO: 765 - protein, 11 aa, Artificial Sequence
  Representative cyclic modulating agent based on OB-cadherin cell adhesion recognition sequence
KFFVIEEYTGD

SEQ ID NO: 766 - protein, 5 aa, Artificial Sequence
  Representative cyclic modulating agent based on OB-cadherin cell adhesion recognition sequence
EEEYK

SEQ ID NO: 767 - protein, 6 aa, Artificial Sequence
  Representative cyclic modulating agent based on OB-cadherin cell adhesion recognition sequence
EIEEYK

SEQ ID NO: 768 - protein, 6 aa, Artificial Sequence
  Representative cyclic modulating agent based on OB-cadherin cell adhesion recognition sequence
EEEYTK

SEQ ID NO: 769 - protein, 7 aa, Artificial Sequence
  Representative cyclic modulating agent based on OB-cadherin cell adhesion recognition sequence
EVIEEYK

SEQ ID NO: 770 - protein, 7 aa, Artificial Sequence
  Representative cyclic modulating agent based on OB-cadherin cell adhesion recognition sequence
EIEEYTK

SEQ ID NO: 771 - protein, 8 aa, Artificial Sequence
  Representative cyclic modulating agent based on OB-cadherin cell adhesion recognition sequence
EVIEEYTK

SEQ ID NO: 772 - protein, 7 aa, Artificial Sequence
  Representative cyclic modulating agent based on OB-cadherin cell adhesion recognition sequence
EEEYTGK

SEQ ID NO: 773 - protein, 8 aa, Artificial Sequence
  Representative cyclic modulating agent based on OB-cadherin cell adhesion recognition sequence
EIEEYTGK

SEQ ID NO: 774 - protein, 9 aa, Artificial Sequence
  Representative cyclic modulating agent based on OB-cadherin cell adhesion recognition sequence
EVIEEYTGK

SEQ ID NO: 775 - protein, 8 aa, Artificial Sequence
  Representative cyclic modulating agent based on OB-cadherin cell adhesion recognition sequence
EFVIEEYK

SEQ ID NO: 776 - protein, 9 aa, Artificial Sequence
  Representative cyclic modulating agent based on OB-cadherin cell adhesion recognition sequence
EFVIEEYTK

SEQ ID NO: 777 - protein, 10 aa, Artificial Sequence
  Representative cyclic modulating agent based on OB-cadherin cell adhesion recognition sequence
EFVIEEYTGK

SEQ ID NO: 778 - protein, 9 aa, Artificial Sequence
  Representative cyclic modulating agent based on OB-cadherin cell adhesion recognition sequence
EFFVIEEYK

SEQ ID NO: 779 - protein, 10 aa, Artificial Sequence
  Representative cyclic modulating agent based on OB-cadherin cell adhesion recognition sequence
EFFVIEEYTK

SEQ ID NO: 780 - protein, 11 aa, Artificial Sequence
  Representative cyclic modulating agent based on OB-cadherin cell adhesion recognition sequence
EFFVIEEYTGK

SEQ ID NO: 781 - protein, 6 aa, Artificial Sequence
  Representative cyclic modulating agent based on OB-cadherin cell adhesion recognition sequence
DCEEYK

SEQ ID NO: 782 - protein, 7 aa, Artificial Sequence
  Representative cyclic modulating agent based on OB-cadherin cell adhesion recognition sequence
DIEEYCK

SEQ ID NO: 783 - protein, 6 aa, Artificial Sequence
  Representative cyclic modulating agent based on OB-cadherin cell adhesion recognition sequence
DEEYTK

SEQ ID NO: 784 - protein, 7 aa, Artificial Sequence
  Representative cyclic modulating agent based on OB-cadherin cell adhesion recognition sequence
DVIEEYK

SEQ ID NO: 785 - protein, 7 aa, Artificial Sequence
  Representative cyclic modulating agent based on OB-cadherin cell adhesion recognition sequence
DIEEYTK

SEQ ID NO: 786 - protein, 8 aa, Artificial Sequence
  Representative cyclic modulating agent based on OB-cadherin cell adhesion recognition sequence
DVIEEYTK

SEQ ID NO: 787 - protein, 7 aa, Artificial Sequence
  Representative cyclic modulating agent based on OB-cadherin cell adhesion recognition sequence
DEEYTGK

SEQ ID NO: 788 - protein, 8 aa, Artificial Sequence
  Representative cyclic modulating agent based on OB-cadherin cell adhesion recognition sequence
DIEEYTGK

SEQ ID NO: 789 - protein, 9 aa, Artificial Sequence
  Representative cyclic modulating agent based on OB-cadherin cell adhesion recognition sequence
DVIEEYTGK

SEQ ID NO: 790 - protein, 8 aa, Artificial Sequence
  Representative cyclic modulating agent based on OB-cadherin cell adhesion recognition sequence
DFVIEEYK

SEQ ID NO: 791 - protein, 9 aa, Artificial Sequence
  Representative cyclic modulating agent based on OB-cadherin cell adhesion recognition sequence
DFVIEEYTK

SEQ ID NO: 792 - protein, 10 aa, Artificial Sequence
  Representative cyclic modulating agent based on OB-cadherin cell adhesion recognition sequence
DFVIEEYTGK

SEQ ID NO: 793 - protein, 9 aa, Artificial Sequence
  Representative cyclic modulating agent based on OB-cadherin cell adhesion recognition sequence
DFFVIEEYK

SEQ ID NO: 794 - protein, 10 aa, Artificial Sequence
  Representative cyclic modulating agent based on OB-cadherin cell adhesion recognition sequence
DFFVIEEYTK

SEQ ID NO: 795 - protein, 11 aa, Artificial Sequence
  Representative cyclic modulating agent based on OB-cadherin cell adhesion recognition sequence
DFFVIEEYTGK

SEQ ID NO: 796 - protein, 5 aa, Artificial Sequence
  Representative cyclic modulating agent based on OB-cadherin cell adhesion recognition sequence
KEEYE

SEQ ID NO: 797 - protein, 6 aa, Artificial Sequence
  Representative cyclic modulating agent based on OB-cadherin cell adhesion recognition sequence
KIEEYE

SEQ ID NO: 798 - protein, 6 aa, Artificial Sequence
  Representative cyclic modulating agent based on OB-cadherin cell adhesion recognition sequence
KEEYTE

SEQ ID NO: 799 - protein, 7 aa, Artificial Sequence
  Representative cyclic modulating agent based on OB-cadherin cell adhesion recognition sequence
KVIEEYE

SEQ ID NO: 800 - protein, 7 aa, Artificial Sequence
  Representative cyclic modulating agent based on OB-cadherin cell adhesion recognition sequence
KIEEYTE

SEQ ID NO: 801 - protein, 8 aa, Artificial Sequence
  Representative cyclic modulating agent based on OB-cadherin cell adhesion recognition sequence
KVIEEYTE

SEQ ID NO: 802 - protein, 7 aa, Artificial Sequence
  Representative cyclic modulating agent based on OB-cadherin cell adhesion recognition sequence
KEEYTGE

SEQ ID NO: 803 - protein, 8 aa, Artificial Sequence
  Representative cyclic modulating agent based on OB-cadherin cell adhesion recognition sequence
KIEEYTGE

SEQ ID NO: 804 - protein, 9 aa, Artificial Sequence
  Representative cyclic modulating agent based on OB-cadherin cell adhesion recognition sequence
KVIEEYTGE

SEQ ID NO: 805 - protein, 8 aa, Artificial Sequence
  Representative cyclic modulating agent based on OB-cadherin cell adhesion recognition sequence
KFVIEEYE

SEQ ID NO: 806 - protein, 9 aa, Artificial Sequence
  Representative cyclic modulating agent based on OB-cadherin cell adhesion recognition sequence
KFVIEEYTE

SEQ ID NO: 807 - protein, 10 aa, Artificial Sequence
  Representative cyclic modulating agent based on OB-cadherin cell adhesion recognition sequence
KFVIEEYTGE

SEQ ID NO: 808 - protein, 9 aa, Artificial Sequence
  Representative cyclic modulating agent based on OB-cadherin cell adhesion recognition sequence
KFFVIEEYE

SEQ ID NO: 809 - protein, 10 aa, Artificial Sequence
  Representative cyclic modulating agent based on OB-cadherin cell adhesion recognition sequence
KFFVIEEYTE

SEQ ID NO: 810 - protein, 11 aa, Artificial Sequence
  Representative cyclic modulating agent based on OB-cadherin cell adhesion recognition sequence
KFFVIEEYTGE

SEQ ID NO: 811 - protein, 5 aa, Artificial Sequence
  Representative cyclic modulating agent based on OB-cadherin cell adhesion recognition sequence
VIEEY

SEQ ID NO: 812 - protein, 5 aa, Artificial Sequence
  Representative cyclic modulating agent based on OB-cadherin cell adhesion recognition sequence
IEEYT

SEQ ID NO: 813 - protein, 6 aa, Artificial Sequence
  Representative cyclic modulating agent based on OB-cadherin cell adhesion recognition sequence
VIEEYT

SEQ ID NO: 814 - protein, 5 aa, Artificial Sequence
  Representative cyclic modulating agent based on OB-cadherin cell adhesion recognition sequence
EEYTG

SEQ ID NO: 815 - protein, 6 aa, Artificial Sequence
  Representative cyclic modulating agent based on OB-cadherin cell adhesion recognition sequence
IEEYTG

SEQ ID NO: 816 - protein, 7 aa, Artificial Sequence
  Representative cyclic modulating agent based on OB-cadherin cell adhesion recognition sequence
VIEEYTG

SEQ ID NO: 817 - protein, 6 aa, Artificial Sequence
  Representative cyclic modulating agent based on OB-cadherin cell adhesion recognition sequence
FVIEEY

SEQ ID NO: 818 - protein, 7 aa, Artificial Sequence
  Representative cyclic modulating agent based on OB-cadherin cell adhesion recognition sequence
FVIEEYT

SEQ ID NO: 819 - protein, 8 aa, Artificial Sequence
  Representative cyclic modulating agent based on OB-cadherin cell adhesion recognition sequence
FVIEEYTG

SEQ ID NO: 820 - protein, 7 aa, Artificial Sequence
  Representative cyclic modulating agent based on OB-cadherin cell adhesion recognition sequence
FFVIEEY

SEQ ID NO: 821 - protein, 8 aa, Artificial Sequence
  Representative cyclic modulating agent based on OB-cadherin cell adhesion recognition sequence
FFVIEEYT

SEQ ID NO: 822 - protein, 9 aa, Artificial Sequence
  Representative cyclic modulating agent based on OB-cadherin cell adhesion recognition sequence
FFVIEEYTG

SEQ ID NO: 823 - protein, 5 aa, Artificial Sequence
  Representative cyclic modulating agent based on OB-cadherin cell adhesion recognition sequence
CEAQC

SEQ ID NO: 824 - protein, 6 aa, Artificial Sequence
  Representative cyclic modulating agent based on OB-cadherin cell adhesion recognition sequence
CVEAQC

SEQ ID NO: 825 - protein, 6 aa, Artificial Sequence
  Representative cyclic modulating agent based on OB-cadherin cell adhesion recognition sequence
CEAQTC

SEQ ID NO: 826 - protein, 7 aa, Artificial Sequence
  Representative cyclic modulating agent based on OB-cadherin cell adhesion recognition sequence
CSVEAQC

SEQ ID NO: 827 - protein, 7 aa, Artificial Sequence
  Representative cyclic modulating agent based on OB-cadherin cell adhesion recognition sequence
CVEAQTC

SEQ ID NO: 828 - protein, 8 aa, Artificial Sequence
  Representative cyclic modulating agent based on OB-cadherin cell adhesion recognition sequence
CSVEAQTC

SEQ ID NO: 829 - protein, 7 aa, Artificial Sequence
  Representative cyclic modulating agent based on OB-cadherin cell adhesion recognition sequence
CEAQTGC

SEQ ID NO: 830 - protein, 8 aa, Artificial Sequence
  Representative cyclic modulating agent based on OB-cadherin cell adhesion recognition sequence
CVEAQTGC

SEQ ID NO: 831 - protein, 9 aa, Artificial Sequence
  Representative cyclic modulating agent based on OB-cadherin cell adhesion recognition sequence
CSVEAQTGC

SEQ ID NO: 832 - protein, 8 aa, Artificial Sequence
  Representative cyclic modulating agent based on OB-cadherin cell adhesion recognition sequence
CFSVEAQC

SEQ ID NO: 833 - protein, 9 aa, Artificial Sequence
  Representative cyclic modulating agent based on OB-cadherin cell adhesion recognition sequence
CFSVEAQTC

SEQ ID NO: 834 - protein, 10 aa, Artificial Sequence
  Representative cyclic modulating agent based on OB-cadherin cell adhesion recognition sequence
CFSVEAQTGC

SEQ ID NO: 835 - protein, 9 aa, Artificial Sequence
  Representative cyclic modulating agent based on OB-cadherin cell adhesion recognition sequence
CYFSVEAQC

SEQ ID NO: 836 - protein, 10 aa, Artificial Sequence
  Representative cyclic modulating agent based on OB-cadherin cell adhesion recognition sequence
CYFSVEAQTC

SEQ ID NO: 837 - protein, 11 aa, Artificial Sequence
  Representative cyclic modulating agent based on OB-cadherin cell adhesion recognition sequence
CYFSVEAQTGC

SEQ ID NO: 838 - protein, 5 aa, Artificial Sequence
  Representative cyclic modulating agent based on OB-cadherin cell adhesion recognition sequence
KEAQD

SEQ ID NO: 839 - protein, 6 aa, Artificial Sequence
  Representative cyclic modulating agent based on OB-cadherin cell adhesion recognition sequence
KVEAQD

SEQ ID NO: 840 - protein, 6 aa, Artificial Sequence
  Representative cyclic modulating agent based on OB-cadherin cell adhesion recognition sequence
KEAQTD

SEQ ID NO: 841 - protein, 7 aa, Artificial Sequence
  Representative cyclic modulating agent based on OB-cadherin cell adhesion recognition sequence
KSVEAQD

SEQ ID NO: 842 - protein, 7 aa, Artificial Sequence
  Representative cyclic modulating agent based on OB-cadherin cell adhesion recognition sequence
KVEAQTD

SEQ ID NO: 843 - protein, 8 aa, Artificial Sequence
  Representative cyclic modulating agent based on OB-cadherin cell adhesion recognition sequence
KSVEAQTD

SEQ ID NO: 844 - protein, 7 aa, Artificial Sequence
  Representative cyclic modulating agent based on OB-cadherin cell adhesion recognition sequence
KEAQTGD

SEQ ID NO: 845 - protein, 8 aa, Artificial Sequence
  Representative cyclic modulating agent based on OB-cadherin cell adhesion recognition sequence
KVEAQTGD

SEQ ID NO: 846 - protein, 9 aa, Artificial Sequence
  Representative cyclic modulating agent based on OB-cadherin cell adhesion recognition sequence
KSVEAQTGD

SEQ ID NO: 847 - protein, 8 aa, Artificial Sequence
  Representative cyclic modulating agent based on OB-cadherin cell adhesion recognition sequence
KFSVEAQD

SEQ ID NO: 848 - protein, 9 aa, Artificial Sequence
  Representative cyclic modulating agent based on OB-cadherin cell adhesion recognition sequence
KFSVEAQTD

SEQ ID NO: 849 - protein, 10 aa, Artificial Sequence
  Representative cyclic modulating agent based on OB-cadherin cell adhesion recognition sequence
KFSVEAQTGD

SEQ ID NO: 850 - protein, 9 aa, Artificial Sequence
  Representative cyclic modulating agent based on OB-cadherin cell adhesion recognition sequence
KYFSVEAQD

SEQ ID NO: 851 - protein, 10 aa, Artificial Sequence
  Representative cyclic modulating agent based on OB-cadherin cell adhesion recognition sequence
KYFSVEAQTD

SEQ ID NO: 852 - protein, 11 aa, Artificial Sequence
  Representative cyclic modulating agent based on OB-cadherin cell adhesion recognition sequence
KYFSVEAQTGD

SEQ ID NO: 853 - protein, 5 aa, Artificial Sequence
  Representative cyclic modulating agent based on OB-cadherin cell adhesion recognition sequence
EEAQK

SEQ ID NO: 854 - protein, 6 aa, Artificial Sequence
  Representative cyclic modulating agent based on OB-cadherin cell adhesion recognition sequence
EVEAQK

SEQ ID NO: 855 - protein, 6 aa, Artificial Sequence
  Representative cyclic modulating agent based on OB-cadherin cell adhesion recognition sequence
EEAQTK

SEQ ID NO: 856 - protein, 7 aa, Artificial Sequence
  Representative cyclic modulating agent based on OB-cadherin cell adhesion recognition sequence
ESVEAQK

SEQ ID NO: 857 - protein, 7 aa, Artificial Sequence
  Representative cyclic modulating agent based on OB-cadherin cell adhesion recognition sequence
EVEAQTK

SEQ ID NO: 858 - protein, 8 aa, Artificial Sequence
  Representative cyclic modulating agent based on OB-cadherin cell adhesion recognition sequence
ESVEAQTK

SEQ ID NO: 859 - protein, 7 aa, Artificial Sequence
  Representative cyclic modulating agent based on OB-cadherin cell adhesion recognition sequence
EEAQTGK

SEQ ID NO: 860 - protein, 8 aa, Artificial Sequence
  Representative cyclic modulating agent based on OB-cadherin cell adhesion recognition sequence
EVEAQTGK

SEQ ID NO: 861 - protein, 9 aa, Artificial Sequence
  Representative cyclic modulating agent based on OB-cadherin cell adhesion recognition sequence
ESVEAQTGK

SEQ ID NO: 862 - protein, 8 aa, Artificial Sequence
  Representative cyclic modulating agent based on OB-cadherin cell adhesion recognition sequence
EFSVEAQK

SEQ ID NO: 863 - protein, 9 aa, Artificial Sequence
  Representative cyclic modulating agent based on OB-cadherin cell adhesion recognition sequence
EFSVEAQTK

SEQ ID NO: 864 - protein, 10 aa, Artificial Sequence
  Representative cyclic modulating agent based on OB-cadherin cell adhesion recognition sequence
EFSVEAQTGK

SEQ ID NO: 865 - protein, 9 aa, Artificial Sequence
  Representative cyclic modulating agent based on OB-cadherin cell adhesion recognition sequence
EYFSVEAQK

SEQ ID NO: 866 - protein, 10 aa, Artificial Sequence
  Representative cyclic modulating agent based on OB-cadherin cell adhesion recognition sequence
EYFSVEAQTK

SEQ ID NO: 867 - protein, 11 aa, Artificial Sequence
  Representative cyclic modulating agent based on OB-cadherin cell adhesion recognition sequence
EYFSVEAQTGK

SEQ ID NO: 868 - protein, 5 aa, Artificial Sequence
  Representative cyclic modulating agent based on OB-cadherin cell adhesion recognition sequence
DEAQK

SEQ ID NO: 869 - protein, 6 aa, Artificial Sequence
  Representative cyclic modulating agent based on OB-cadherin cell adhesion recognition sequence
DVEAQK

SEQ ID NO: 870 - protein, 6 aa, Artificial Sequence
  Representative cyclic modulating agent based on OB-cadherin cell adhesion recognition sequence
DEAQTK

SEQ ID NO: 871 - protein, 7 aa, Artificial Sequence
  Representative cyclic modulating agent based on OB-cadherin cell adhesion recognition sequence
DSVEAQK

SEQ ID NO: 872 - protein, 7 aa, Artificial Sequence
  Representative cyclic modulating agent based on OB-cadherin cell adhesion recognition sequence
DVEAQTK

SEQ ID NO: 873 - protein, 8 aa, Artificial Sequence
  Representative cyclic modulating agent based on OB-cadherin cell adhesion recognition sequence
DSVEAQTK

SEQ ID NO: 874 - protein, 7 aa, Artificial Sequence
  Representative cyclic modulating agent based on OB-cadherin cell adhesion recognition sequence
DEAQTGK

SEQ ID NO: 875 - protein, 8 aa, Artificial Sequence
  Representative cyclic modulating agent based on OB-cadherin cell adhesion recognition sequence
DVEAQTGK

SEQ ID NO: 876 - protein, 9 aa, Artificial Sequence
  Representative cyclic modulating agent based on OB-cadherin cell adhesion recognition sequence
DSVEAQTGK

SEQ ID NO: 877 - protein, 8 aa, Artificial Sequence
  Representative cyclic modulating agent based on OB-cadherin cell adhesion recognition sequence
DFSVEAQK

SEQ ID NO: 878 - protein, 9 aa, Artificial Sequence
  Representative cyclic modulating agent based on OB-cadherin cell adhesion recognition sequence
DFSVEAQTK

SEQ ID NO: 879 - protein, 10 aa, Artificial Sequence
  Representative cyclic modulating agent based on OB-cadherin cell adhesion recognition sequence
DFSVEAQTGK

SEQ ID NO: 880 - protein, 9 aa, Artificial Sequence
  Representative cyclic modulating agent based on OB-cadherin cell adhesion recognition sequence
DYFSVEAQK

SEQ ID NO: 881 - protein, 10 aa, Artificial Sequence
  Representative cyclic modulating agent based on OB-cadherin cell adhesion recognition sequence
DYFSVEAQTK

SEQ ID NO: 882 - protein, 11 aa, Artificial Sequence
  Representative cyclic modulating agent based on OB-cadherin cell adhesion recognition sequence
DYFSVEAQTGK

SEQ ID NO: 883 - protein, 5 aa, Artificial Sequence
  Representative cyclic modulating agent based on OB-cadherin cell adhesion recognition sequence
KEAQE

SEQ ID NO: 884 - protein, 6 aa, Artificial Sequence
  Representative cyclic modulating agent based on OB-cadherin cell adhesion recognition sequence
KVEAQE

SEQ ID NO: 885 - protein, 6 aa, Artificial Sequence
  Representative cyclic modulating agent based on OB-cadherin cell adhesion recognition sequence
KEAQTE

SEQ ID NO: 886 - protein, 7 aa, Artificial Sequence
  Representative cyclic modulating agent based on OB-cadherin cell adhesion recognition sequence
KSVEAQE

SEQ ID NO: 887 - protein, 7 aa, Artificial Sequence
  Representative cyclic modulating agent based on OB-cadherin cell adhesion recognition sequence
KVEAQTE

SEQ ID NO: 888 - protein, 8 aa, Artificial Sequence
  Representative cyclic modulating agent based on OB-cadherin cell adhesion recognition sequence
KSVEAQTE

SEQ ID NO: 889 - protein, 7 aa, Artificial Sequence
  Representative cyclic modulating agent based on OB-cadherin cell adhesion recognition sequence
KEAQTGE

SEQ ID NO: 890 - protein, 8 aa, Artificial Sequence
  Representative cyclic modulating agent based on OB-cadherin cell adhesion recognition sequence
KVEAQTGE

SEQ ID NO: 891 - protein, 9 aa, Artificial Sequence
  Representative cyclic modulating agent based on OB-cadherin cell adhesion recognition sequence
KSVEAQTGE

SEQ ID NO: 892 - protein, 8 aa, Artificial Sequence
  Representative cyclic modulating agent based on OB-cadherin cell adhesion recognition sequence
KFSVEAQE

SEQ ID NO: 893 - protein, 9 aa, Artificial Sequence
  Representative cyclic modulating agent based on OB-cadherin cell adhesion recognition sequence
KFSVEAQTE

SEQ ID NO: 894 - protein, 10 aa, Artificial Sequence
  Representative cyclic modulating agent based on OB-cadherin cell adhesion recognition sequence
KFSVEAQTGE

SEQ ID NO: 895 - protein, 9 aa, Artificial Sequence
  Representative cyclic modulating agent based on OB-cadherin cell adhesion recognition sequence
KYFSVEAQE

SEQ ID NO: 896 - protein, 10 aa, Artificial Sequence
  Representative cyclic modulating agent based on OB-cadherin cell adhesion recognition sequence
KYFSVEAQTE

SEQ ID NO: 897 - protein, 11 aa, Artificial Sequence
  Representative cyclic modulating agent based on OB-cadherin cell adhesion recognition sequence
KYFSVEAQTGE

SEQ ID NO: 898 - protein, 5 aa, Artificial Sequence
  Representative cyclic modulating agent based on OB-cadherin cell adhesion recognition sequence
SVEAQ

SEQ ID NO: 899 - protein, 5 aa, Artificial Sequence
  Representative cyclic modulating agent based on OB-cadherin cell adhesion recognition sequence
VEAQT

SEQ ID NO: 900 - protein, 6 aa, Artificial Sequence
  Representative cyclic modulating agent based on OB-cadherin cell adhesion recognition sequence
SVEAQT

SEQ ID NO: 901 - protein, 5 aa, Artificial Sequence
  Representative cyclic modulating agent based on OB-cadherin cell adhesion recognition sequence
EAQTG

SEQ ID NO: 902 - protein, 6 aa, Artificial Sequence
  Representative cyclic modulating agent based on OB-cadherin cell adhesion recognition sequence
VEAQTG

SEQ ID NO: 903 - protein, 7 aa, Artificial Sequence
  Representative cyclic modulating agent based on OB-cadherin cell adhesion recognition sequence
SVEAQTG

SEQ ID NO: 904 - protein, 6 aa, Artificial Sequence
  Representative cyclic modulating agent based on OB-cadherin cell adhesion recognition sequence
FSVEAQ

SEQ ID NO: 905 - protein, 7 aa, Artificial Sequence
  Representative cyclic modulating agent based on OB-cadherin cell adhesion recognition sequence
FSVEAQT

SEQ ID NO: 906 - protein, 8 aa, Artificial Sequence
  Representative cyclic modulating agent based on OB-cadherin cell adhesion recognition sequence
FSVEAQTG

SEQ ID NO: 907 - protein, 7 aa, Artificial Sequence
  Representative cyclic modulating agent based on OB-cadherin cell adhesion recognition sequence
YFSVEAQ

SEQ ID NO: 908 - protein, 8 aa, Artificial Sequence
  Representative cyclic modulating agent based on OB-cadherin cell adhesion recognition sequence
YFSVEAQT

SEQ ID NO: 909 - protein, 9 aa, Artificial Sequence
  Representative cyclic modulating agent based on OB-cadherin cell adhesion recognition sequence
YFSVEAQTG

SEQ ID NO: 910 - protein, 5 aa, Artificial Sequence
  Representative cyclic modulating agent based on cadherin-5 cell adhesion recognition sequence
CDAEC

SEQ ID NO: 911 - protein, 6 aa, Artificial Sequence
  Representative cyclic modulating agent based on cadherin-5 cell adhesion recognition sequence
CVDAEC

SEQ ID NO: 912 - protein, 6 aa, Artificial Sequence
  Representative cyclic modulating agent based on cadherin-5 cell adhesion recognition sequence
CDAETC

SEQ ID NO: 913 - protein, 7 aa, Artificial Sequence
  Representative cyclic modulating agent based on cadherin-5 cell adhesion recognition sequence
CRVDAEC

SEQ ID NO: 914 - protein, 7 aa, Artificial Sequence
  Representative cyclic modulating agent based on cadherin-5 cell adhesion recognition sequence
CVDAETC

SEQ ID NO: 915 - protein, 8 aa, Artificial Sequence
  Representative cyclic modulating agent based on cadherin-5 cell adhesion recognition sequence
CRVDAETC

SEQ ID NO: 916 - protein, 7 aa, Artificial Sequence
  Representative cyclic modulating agent based on cadherin-5 cell adhesion recognition sequence
CDAETGC

SEQ ID NO: 917 - protein, 8 aa, Artificial Sequence
  Representative cyclic modulating agent based on cadherin-5 cell adhesion recognition sequence
CCDAETGC

SEQ ID NO: 918 - protein, 9 aa, Artificial Sequence
  Representative cyclic modulating agent based on cadherin-5 cell adhesion recognition sequence
CRVDAETGC

SEQ ID NO: 919 - protein, 8 aa, Artificial Sequence
  Representative cyclic modulating agent based on cadherin-5 cell adhesion recognition sequence
CFRVDAEC

SEQ ID NO: 920 - protein, 9 aa, Artificial Sequence
  Representative cyclic modulating agent based on cadherin-5 cell adhesion recognition sequence
CFRVDAETC

SEQ ID NO: 921 - protein, 10 aa, Artificial Sequence
  Representative cyclic modulating agent based on cadherin-5 cell adhesion recognition sequence
CFRVDAETGC

SEQ ID NO: 922 - protein, 9 aa, Artificial Sequence
  Representative cyclic modulating agent based on cadherin-5 cell adhesion recognition sequence
CVFRVDAEC

SEQ ID NO: 923 - protein, 10 aa, Artificial Sequence
  Representative cyclic modulating agent based on cadherin-5 cell adhesion recognition sequence
CVFRVDAETC

SEQ ID NO: 924 - protein, 11 aa, Artificial Sequence
  Representative cyclic modulating agent based on cadherin-5 cell adhesion recognition sequence
CVFRVDAETGC

SEQ ID NO: 925 - protein, 5 aa, Artificial Sequence
  Representative cyclic modulating agent based on cadherin-5 cell adhesion recognition sequence
DDAEK

SEQ ID NO: 926 - protein, 6 aa, Artificial Sequence
  Representative cyclic modulating agent based on cadherin-5 cell adhesion recognition sequence
DVDAEK

SEQ ID NO: 927 - protein, 7 aa, Artificial Sequence
  Representative cyclic modulating agent based on cadherin-5 cell adhesion recognition sequence
DRVDAEK

SEQ ID NO: 928 - protein, 8 aa, Artificial Sequence
  Representative cyclic modulating agent based on cadherin-5 cell adhesion recognition sequence
DFRVDAEK

SEQ ID NO: 929 - protein, 9 aa, Artificial Sequence
  Representative cyclic modulating agent based on cadherin-5 cell adhesion recognition sequence
DVFRVDAEK

SEQ ID NO: 930 - protein, 5 aa, Artificial Sequence
  Representative cyclic modulating agent based on cadherin-5 cell adhesion recognition sequence
EDAEK

SEQ ID NO: 931 - protein, 6 aa, Artificial Sequence
  Representative cyclic modulating agent based on cadherin-5 cell adhesion recognition sequence
EVDAEK

SEQ ID NO: 932 - protein, 7 aa, Artificial Sequence
  Representative cyclic modulating agent based on cadherin-5 cell adhesion recognition sequence
ERVDAEK

SEQ ID NO: 933 - protein, 8 aa, Artificial Sequence
  Representative cyclic modulating agent based on cadherin-5 cell adhesion recognition sequence
EFRVDAEK

SEQ ID NO: 934 - protein, 9 aa, Artificial Sequence
  Representative cyclic modulating agent based on cadherin-5 cell adhesion recognition sequence
EVFRVDAEK

SEQ ID NO: 935 - protein, 5 aa, Artificial Sequence
  Representative cyclic modulating agent based on cadherin-5 cell adhesion recognition sequence
KDAED

SEQ ID NO: 936 - protein, 6 aa, Artificial Sequence
  Representative cyclic modulating agent based on cadherin-5 cell adhesion recognition sequence
KVDAED

SEQ ID NO: 937 - protein, 6 aa, Artificial Sequence
  Representative cyclic modulating agent based on cadherin-5 cell adhesion recognition sequence
KDAETD

SEQ ID NO: 938 - protein, 7 aa, Artificial Sequence
  Representative cyclic modulating agent based on cadherin-5 cell adhesion recognition sequence
KRVDAED

SEQ ID NO: 939 - protein, 7 aa, Artificial Sequence
  Representative cyclic modulating agent based on cadherin-5 cell adhesion recognition sequence
KVDAETD

SEQ ID NO: 940 - protein, 8 aa, Artificial Sequence
  Representative cyclic modulating agent based on cadherin-5 cell adhesion recognition sequence
KRVDAETD

SEQ ID NO: 941 - protein, 7 aa, Artificial Sequence
  Representative cyclic modulating agent based on cadherin-5 cell adhesion recognition sequence
KDAETGD

SEQ ID NO: 942 - protein, 8 aa, Artificial Sequence
  Representative cyclic modulating agent based on cadherin-5 cell adhesion recognition sequence
KVDAETGD

SEQ ID NO: 943 - protein, 9 aa, Artificial Sequence
  Representative cyclic modulating agent based on cadherin-5 cell adhesion recognition sequence
KRVDAETGD

SEQ ID NO: 944 - protein, 8 aa, Artificial Sequence
  Representative cyclic modulating agent based on cadherin-5 cell adhesion recognition sequence
KFRVDAED

SEQ ID NO: 945 - protein, 9 aa, Artificial Sequence
  Representative cyclic modulating agent based on cadherin-5 cell adhesion recognition sequence
KFRVDAETD

SEQ ID NO: 946 - protein, 10 aa, Artificial Sequence
  Representative cyclic modulating agent based on cadherin-5 cell adhesion recognition sequence
KFRVDAETGD

SEQ ID NO: 947 - protein, 9 aa, Artificial Sequence
  Representative cyclic modulating agent based on cadherin-5 cell adhesion recognition sequence
KVFRVDAED

SEQ ID NO: 948 - protein, 10 aa, Artificial Sequence
  Representative cyclic modulating agent based on cadherin-5 cell adhesion recognition sequence
KVFRVDAETD

SEQ ID NO: 949 - protein, 11 aa, Artificial Sequence
  Representative cyclic modulating agent based on cadherin-5 cell adhesion recognition sequence
KVFRVDAETGD

SEQ ID NO: 950 - protein, 5 aa, Artificial Sequence
  Representative cyclic modulating agent based on cadherin-5 cell adhesion recognition sequence
VDAEK

SEQ ID NO: 951 - protein, 5 aa, Artificial Sequence
  Representative cyclic modulating agent based on cadherin-5 cell adhesion recognition sequence
IDAES

SEQ ID NO: 952 - protein, 5 aa, Artificial Sequence
  Representative cyclic modulating agent based on cadherin-5 cell adhesion recognition sequence
VDAES

SEQ ID NO: 953 - protein, 5 aa, Artificial Sequence
  Representative cyclic modulating agent based on cadherin-5 cell adhesion recognition sequence
DAETG

SEQ ID NO: 954 - protein, 6 aa, Artificial Sequence
  Representative cyclic modulating agent based on cadherin-5 cell adhesion recognition sequence
VDAETG

SEQ ID NO: 955 - protein, 5 aa, Artificial Sequence
  Representative cyclic modulating agent based on cadherin-5 cell adhesion recognition sequence
KDAEE

SEQ ID NO: 956 - protein, 5 aa, Artificial Sequence
  Representative cyclic modulating agent based on cadherin-5 cell adhesion recognition sequence
KVDAE

SEQ ID NO: 957 - protein, 6 aa, Artificial Sequence
  Representative cyclic modulating agent based on cadherin-5 cell adhesion recognition sequence
KDAETE

SEQ ID NO: 958 - protein, 6 aa, Artificial Sequence
  Representative cyclic modulating agent based on cadherin-5 cell adhesion recognition sequence
KRVDAE

SEQ ID NO: 959 - protein, 7 aa, Artificial Sequence
  Representative cyclic modulating agent based on cadherin-5 cell adhesion recognition sequence
KVDAETE

SEQ ID NO: 960 - protein, 8 aa, Artificial Sequence
  Representative cyclic modulating agent based on cadherin-5 cell adhesion recognition sequence
KRVDAETE

SEQ ID NO: 961 - protein, 7 aa, Artificial Sequence
  Representative cyclic modulating agent based on cadherin-5 cell adhesion recognition sequence
KDAETGE

SEQ ID NO: 962 - protein, 8 aa, Artificial Sequence
  Representative cyclic modulating agent based on cadherin-5 cell adhesion recognition sequence
KVDAETGE

SEQ ID NO: 963 - protein, 9 aa, Artificial Sequence
  Representative cyclic modulating agent based on cadherin-5 cell adhesion recognition sequence
KRVDAETGE

SEQ ID NO: 964 - protein, 7 aa, Artificial Sequence
  Representative cyclic modulating agent based on cadherin-5 cell adhesion recognition sequence
KFRVDAE

SEQ ID NO: 965 - protein, 9 aa, Artificial Sequence
  Representative cyclic modulating agent based on cadherin-5 cell adhesion recognition sequence
KFRVDAETE

SEQ ID NO: 966 - protein, 10 aa, Artificial Sequence
  Representative cyclic modulating agent based on cadherin-5 cell adhesion recognition sequence
KFRVDAETGE

SEQ ID NO: 967 - protein, 8 aa, Artificial Sequence
  Representative cyclic modulating agent based on cadherin-5 cell adhesion recognition sequence
KVFRVDAE

SEQ ID NO: 968 - protein, 10 aa, Artificial Sequence
  Representative cyclic modulating agent based on cadherin-5 cell adhesion recognition sequence
KVFRVDAETE

SEQ ID NO: 969 - protein, 11 aa, Artificial Sequence
  Representative cyclic modulating agent based on cadherin-5 cell adhesion recognition sequence
KVFRVDAETGE

SEQ ID NO: 970 - protein, 5 aa, Artificial Sequence
  Representative cyclic modulating agent based on cadherin-5 cell adhesion recognition sequence
VDAET

SEQ ID NO: 971 - protein, 6 aa, Artificial Sequence
  Representative cyclic modulating agent based on cadherin-5 cell adhesion recognition sequence
VDAETG

SEQ ID NO: 972 - protein, 5 aa, Artificial Sequence
  Representative cyclic modulating agent based on cadherin-5 cell adhesion recognition sequence
DAETG

SEQ ID NO: 973 - protein, 5 aa, Artificial Sequence
  Representative cyclic modulating agent based on cadherin-5 cell adhesion recognition sequence
RVDAE

SEQ ID NO: 974 - protein, 6 aa, Artificial Sequence
  Representative cyclic modulating agent based on cadherin-5 cell adhesion recognition sequence
RVDAET

SEQ ID NO: 975 - protein, 7 aa, Artificial Sequence
  Representative cyclic modulating agent based on cadherin-5 cell adhesion recognition sequence
RVDAETG

SEQ ID NO: 976 - protein, 6 aa, Artificial Sequence
  Representative cyclic modulating agent based on cadherin-5 cell adhesion recognition sequence
FRVDAE

SEQ ID NO: 977 - protein, 7 aa, Artificial Sequence
  Representative cyclic modulating agent based on cadherin-5 cell adhesion recognition sequence
FRVDAET

SEQ ID NO: 978 - protein, 8 aa, Artificial Sequence
  Representative cyclic modulating agent based on cadherin-5 cell adhesion recognition sequence
FRVDAETG

SEQ ID NO: 979 - protein, 7 aa, Artificial Sequence
  Representative cyclic modulating agent based on cadherin-5 cell adhesion recognition sequence
VFRVDAE

SEQ ID NO: 980 - protein, 8 aa, Artificial Sequence
  Representative cyclic modulating agent based on cadherin-5 cell adhesion recognition sequence
VFRVDAET

SEQ ID NO: 981 - protein, 9 aa, Artificial Sequence
  Representative cyclic modulating agent based on cadherin-5 cell adhesion recognition sequence
VFRVDAETG

SEQ ID NO: 982 - protein, 6 aa, Artificial Sequence
  Representative cyclic modulating agent based on cadherin-6 cell adhesion recognition sequence
DNENTK

SEQ ID NO: 983 - protein, 5 aa, Artificial Sequence
  Representative cyclic modulating agent based on cadherin-6 cell adhesion recognition sequence
CNENC

SEQ ID NO: 984 - protein, 6 aa, Artificial Sequence
  Representative cyclic modulating agent based on cadherin-6 cell adhesion recognition sequence
CINENC

SEQ ID NO: 985 - protein, 6 aa, Artificial Sequence
  Representative cyclic modulating agent based on cadherin-6 cell adhesion recognition sequence
CNENTC

SEQ ID NO: 986 - protein, 7 aa, Artificial Sequence
  Representative cyclic modulating agent based on cadherin-6 cell adhesion recognition sequence
CIINENC

SEQ ID NO: 987 - protein, 7 aa, Artificial Sequence
  Representative cyclic modulating agent based on cadherin-6 cell adhesion recognition sequence
CINENTC

SEQ ID NO: 988 - protein, 8 aa, Artificial Sequence
  Representative cyclic modulating agent based on cadherin-6 cell adhesion recognition sequence
CIINENTC

SEQ ID NO: 989 - protein, 7 aa, Artificial Sequence
  Representative cyclic modulating agent based on cadherin-6 cell adhesion recognition sequence
CNENTGC

SEQ ID NO: 990 - protein, 8 aa, Artificial Sequence
  Representative cyclic modulating agent based on cadherin-6 cell adhesion recognition sequence
CINENTGC

SEQ ID NO: 991 - protein, 9 aa, Artificial Sequence
  Representative cyclic modulating agent based on cadherin-6 cell adhesion recognition sequence
CIINENTGC

SEQ ID NO: 992 - protein, 8 aa, Artificial Sequence
  Representative cyclic modulating agent based on cadherin-6 cell adhesion recognition sequence
CFIINENC

SEQ ID NO: 993 - protein, 9 aa, Artificial Sequence
  Representative cyclic modulating agent based on cadherin-6 cell adhesion recognition sequence
CFIINENTC

SEQ ID NO: 994 - protein, 10 aa, Artificial Sequence
  Representative cyclic modulating agent based on cadherin-6 cell adhesion recognition sequence
CFIINENTGC

SEQ ID NO: 995 - protein, 9 aa, Artificial Sequence
  Representative cyclic modulating agent based on cadherin-6 cell adhesion recognition sequence
CLFIINENC

SEQ ID NO: 996 - protein, 10 aa, Artificial Sequence
  Representative cyclic modulating agent based on cadherin-6 cell adhesion recognition sequence
CLFIINENTC

SEQ ID NO: 997 - protein, 11 aa, Artificial Sequence
  Representative cyclic modulating agent based on cadherin-6 cell adhesion recognition sequence
CLFIINENTGC

SEQ ID NO: 998 - protein, 5 aa, Artificial Sequence
  Representative cyclic modulating agent based on cadherin-6 cell adhesion recognition sequence
DNENK

SEQ ID NO: 999 - protein, 6 aa, Artificial Sequence
  Representative cyclic modulating agent based on cadherin-6 cell adhesion recognition sequence
DINENK

SEQ ID NO: 1000 - protein, 7 aa, Artificial Sequence
  Representative cyclic modulating agent based on cadherin-6 cell adhesion recognition sequence
DIINENK

SEQ ID NO: 1001 - protein, 8 aa, Artificial Sequence
  Representative cyclic modulating agent based on cadherin-6 cell adhesion recognition sequence
DFIINENK

SEQ ID NO: 1002 - protein, 9 aa, Artificial Sequence
  Representative cyclic modulating agent based on cadherin-6 cell adhesion recognition sequence
DLFIINENK

SEQ ID NO: 1003 - protein, 5 aa, Artificial Sequence
  Representative cyclic modulating agent based on cadherin-6 cell adhesion recognition sequence
ENENK

SEQ ID NO: 1004 - protein, 6 aa, Artificial Sequence
  Representative cyclic modulating agent based on cadherin-6 cell adhesion recognition sequence
EINENK

SEQ ID NO: 1005 - protein, 7 aa, Artificial Sequence
  Representative cyclic modulating agent based on cadherin-6 cell adhesion recognition sequence
EIINENK

SEQ ID NO: 1006 - protein, 8 aa, Artificial Sequence
  Representative cyclic modulating agent based on cadherin-6 cell adhesion recognition sequence
EFIINENK

SEQ ID NO: 1007 - protein, 9 aa, Artificial Sequence
  Representative cyclic modulating agent based on cadherin-6 cell adhesion recognition sequence
ELFIINENK

SEQ ID NO: 1008 - protein, 5 aa, Artificial Sequence
  Representative cyclic modulating agent based on cadherin-6 cell adhesion recognition sequence
KNEND

SEQ ID NO: 1009 - protein, 6 aa, Artificial Sequence
  Representative cyclic modulating agent based on cadherin-6 cell adhesion recognition sequence
KINEND

SEQ ID NO: 1010 - protein, 6 aa, Artificial Sequence
  Representative cyclic modulating agent based on cadherin-6 cell adhesion recognition sequence
KNENTD

SEQ ID NO: 1011 - protein, 7 aa, Artificial Sequence
  Representative cyclic modulating agent based on cadherin-6 cell adhesion recognition sequence
KIINEND

SEQ ID NO: 1012 - protein, 7 aa, Artificial Sequence
  Representative cyclic modulating agent based on cadherin-6 cell adhesion recognition sequence
KINENTD

SEQ ID NO: 1013 - protein, 8 aa, Artificial Sequence
  Representative cyclic modulating agent based on cadherin-6 cell adhesion recognition sequence
KIINENTD

SEQ ID NO: 1014 - protein, 7 aa, Artificial Sequence
  Representative cyclic modulating agent based on cadherin-6 cell adhesion recognition sequence
KNENTGD

SEQ ID NO: 1015 - protein, 8 aa, Artificial Sequence
  Representative cyclic modulating agent based on cadherin-6 cell adhesion recognition sequence
KINENTGD

SEQ ID NO: 1016 - protein, 9 aa, Artificial Sequence
  Representative cyclic modulating agent based on cadherin-6 cell adhesion recognition sequence
KIINENTGD

SEQ ID NO: 1017 - protein, 8 aa, Artificial Sequence
  Representative cyclic modulating agent based on cadherin-6 cell adhesion recognition sequence
KFIINEND

SEQ ID NO: 1018 - protein, 9 aa, Artificial Sequence
  Representative cyclic modulating agent based on cadherin-6 cell adhesion recognition sequence
KFIINENTD

SEQ ID NO: 1019 - protein, 10 aa, Artificial Sequence
  Representative cyclic modulating agent based on cadherin-6 cell adhesion recognition sequence
KFIINENTGD

SEQ ID NO: 1020 - protein, 9 aa, Artificial Sequence
  Representative cyclic modulating agent based on cadherin-6 cell adhesion recognition sequence
KLFIINEND

SEQ ID NO: 1021 - protein, 10 aa, Artificial Sequence
  Representative cyclic modulating agent based on cadherin-6 cell adhesion recognition sequence
KLFIINENTD

SEQ ID NO: 1022 - protein, 11 aa, Artificial Sequence
  Representative cyclic modulating agent based on cadherin-6 cell adhesion recognition sequence
KLFIINENTGD

SEQ ID NO: 1023 - protein, 5 aa, Artificial Sequence
  Representative cyclic modulating agent based on cadherin-6 cell adhesion recognition sequence
VNENT

SEQ ID NO: 1024 - protein, 5 aa, Artificial Sequence
  Representative cyclic modulating agent based on cadherin-6 cell adhesion recognition sequence
INENT

SEQ ID NO: 1025 - protein, 6 aa, Artificial Sequence
  Representative cyclic modulating agent based on cadherin-6 cell adhesion recognition sequence
IINENT

SEQ ID NO: 1026 - protein, 5 aa, Artificial Sequence
  Representative cyclic modulating agent based on cadherin-6 cell adhesion recognition sequence
NENTG

SEQ ID NO: 1027 - protein, 6 aa, Artificial Sequence
  Representative cyclic modulating agent based on cadherin-6 cell adhesion recognition sequence
INENTG

SEQ ID NO: 1028 - protein, 5 aa, Artificial Sequence
  Representative cyclic modulating agent based on cadherin-6 cell adhesion recognition sequence
KNENE

SEQ ID NO: 1029 - protein, 6 aa, Artificial Sequence
  Representative cyclic modulating agent based on cadherin-6 cell adhesion recognition sequence
KINENE

SEQ ID NO: 1030 - protein, 6 aa, Artificial Sequence
  Representative cyclic modulating agent based on cadherin-6 cell adhesion recognition sequence
KNENTE

SEQ ID NO: 1031 - protein, 7 aa, Artificial Sequence
  Representative cyclic modulating agent based on cadherin-6 cell adhesion recognition sequence
KIINENE

SEQ ID NO: 1032 - protein, 7 aa, Artificial Sequence
  Representative cyclic modulating agent based on cadherin-6 cell adhesion recognition sequence
KINENTE

SEQ ID NO: 1033 - protein, 8 aa, Artificial Sequence
  Representative cyclic modulating agent based on cadherin-6 cell adhesion recognition sequence
KIINENTE

SEQ ID NO: 1034 - protein, 7 aa, Artificial Sequence
  Representative cyclic modulating agent based on cadherin-6 cell adhesion recognition sequence
KNENTGE

SEQ ID NO: 1035 - protein, 8 aa, Artificial Sequence
  Representative cyclic modulating agent based on cadherin-6 cell adhesion recognition sequence
KINENTGE

SEQ ID NO: 1036 - protein, 9 aa, Artificial Sequence
  Representative cyclic modulating agent based on cadherin-6 cell adhesion recognition sequence
KIINENTGE

SEQ ID NO: 1037 - protein, 8 aa, Artificial Sequence
  Representative cyclic modulating agent based on cadherin-6 cell adhesion recognition sequence
KFIINENE

SEQ ID NO: 1038 - protein, 9 aa, Artificial Sequence
  Representative cyclic modulating agent based on cadherin-6 cell adhesion recognition sequence
KFIINENTE

SEQ ID NO: 1039 - protein, 10 aa, Artificial Sequence
  Representative cyclic modulating agent based on cadherin-6 cell adhesion recognition sequence
KFIINENTGE

SEQ ID NO: 1040 - protein, 9 aa, Artificial Sequence
  Representative cyclic modulating agent based on cadherin-6 cell adhesion recognition sequence
KLFIINENE

SEQ ID NO: 1041 - protein, 10 aa, Artificial Sequence
  Representative cyclic modulating agent based on cadherin-6 cell adhesion recognition sequence
KLFIINENTE

SEQ ID NO: 1042 - protein, 11 aa, Artificial Sequence
  Representative cyclic modulating agent based on cadherin-6 cell adhesion recognition sequence
KLFIINENTGE

SEQ ID NO: 1043 - protein, 5 aa, Artificial Sequence
  Representative cyclic modulating agent based on cadherin-6 cell adhesion recognition sequence
IINEN

SEQ ID NO: 1044 - protein, 6 aa, Artificial Sequence
  Representative cyclic modulating agent based on cadherin-6 cell adhesion recognition sequence
FIINEN

SEQ ID NO: 1045 - protein, 7 aa, Artificial Sequence
  Representative cyclic modulating agent based on cadherin-6 cell adhesion recognition sequence
FIINENT

SEQ ID NO: 1046 - protein, 8 aa, Artificial Sequence
  Representative cyclic modulating agent based on cadherin-6 cell adhesion recognition sequence
FIINENTG

SEQ ID NO: 1047 - protein, 7 aa, Artificial Sequence
  Representative cyclic modulating agent based on cadherin-6 cell adhesion recognition sequence
LFIINEN

SEQ ID NO: 1048 - protein, 8 aa, Artificial Sequence
  Representative cyclic modulating agent based on cadherin-6 cell adhesion recognition sequence
LFIINENT

SEQ ID NO: 1049 - protein, 9 aa, Artificial Sequence
  Representative cyclic modulating agent based on cadherin-6 cell adhesion recognition sequence
LFIINENTG

SEQ ID NO: 1050 - protein, 5 aa, Artificial Sequence
  Representative cyclic modulating agent based on cadherin-6 cell adhesion recognition sequence
CEEYC

SEQ ID NO: 1051 - protein, 6 aa, Artificial Sequence
  Representative cyclic modulating agent based on cadherin-6 cell adhesion recognition sequence
CEEYTC

SEQ ID NO: 1052 - protein, 7 aa, Artificial Sequence
  Representative cyclic modulating agent based on cadherin-6 cell adhesion recognition sequence
CEEYTGC

SEQ ID NO: 1053 - protein, 6 aa, Artificial Sequence
  Representative cyclic modulating agent based on cadherin-6 cell adhesion recognition sequence
CLEEYC

SEQ ID NO: 1054 - protein, 7 aa, Artificial Sequence
  Representative cyclic modulating agent based on cadherin-6 cell adhesion recognition sequence
CLEEYTC

SEQ ID NO: 1055 - protein, 8 aa, Artificial Sequence
  Representative cyclic modulating agent based on cadherin-6 cell adhesion recognition sequence
CLEEYTGC

SEQ ID NO: 1056 - protein, 7 aa, Artificial Sequence
  Representative cyclic modulating agent based on cadherin-6 cell adhesion recognition sequence
CLLEEYC

SEQ ID NO: 1057 - protein, 9 aa, Artificial Sequence
  Representative cyclic modulating agent based on cadherin-6 cell adhesion recognition sequence
CLLEEYTGC

SEQ ID NO: 1058 - protein, 8 aa, Artificial Sequence
  Representative cyclic modulating agent based on cadherin-6 cell adhesion recognition sequence
CFLLEEYC

SEQ ID NO: 1059 - protein, 8 aa, Artificial Sequence
  Representative cyclic modulating agent based on cadherin-6 cell adhesion recognition sequence
CLLEEYTC

SEQ ID NO: 1060 - protein, 10 aa, Artificial Sequence
  Representative cyclic modulating agent based on cadherin-6 cell adhesion recognition sequence
CFLLEEYTGC

SEQ ID NO: 1061 - protein, 9 aa, Artificial Sequence
  Representative cyclic modulating agent based on cadherin-6 cell adhesion recognition sequence
CFFLLEEYC

SEQ ID NO: 1062 - protein, 10 aa, Artificial Sequence
  Representative cyclic modulating agent based on cadherin-6 cell adhesion recognition sequence
CFFLLEEYTC

SEQ ID NO: 1063 - protein, 11 aa, Artificial Sequence
  Representative cyclic modulating agent based on cadherin-6 cell adhesion recognition sequence
CFFLLEEYTGC

SEQ ID NO: 1064 - protein, 5 aa, Artificial Sequence
  Representative cyclic modulating agent based on cadherin-6 cell adhesion recognition sequence
CESEC

SEQ ID NO: 1065 - protein, 6 aa, Artificial Sequence
  Representative cyclic modulating agent based on cadherin-6 cell adhesion recognition sequence
CESETC

SEQ ID NO: 1066 - protein, 7 aa, Artificial Sequence
  Representative cyclic modulating agent based on cadherin-6 cell adhesion recognition sequence
CESETGC

SEQ ID NO: 1067 - protein, 6 aa, Artificial Sequence
  Representative cyclic modulating agent based on cadherin-6 cell adhesion recognition sequence
CVESEC

SEQ ID NO: 1068 - protein, 7 aa, Artificial Sequence
  Representative cyclic modulating agent based on cadherin-6 cell adhesion recognition sequence
CVSESTC

SEQ ID NO: 1069 - protein, 8 aa, Artificial Sequence
  Representative cyclic modulating agent based on cadherin-6 cell adhesion recognition sequence
CVESETGC

SEQ ID NO: 1070 - protein, 7 aa, Artificial Sequence
  Representative cyclic modulating agent based on cadherin-6 cell adhesion recognition sequence
CSVESEC

SEQ ID NO: 1071 - protein, 8 aa, Artificial Sequence
  Representative cyclic modulating agent based on cadherin-6 cell adhesion recognition sequence
CSVESETC

SEQ ID NO: 1072 - protein, 9 aa, Artificial Sequence
  Representative cyclic modulating agent based on cadherin-6 cell adhesion recognition sequence
CSVESETGC

SEQ ID NO: 1073 - protein, 8 aa, Artificial Sequence
  Representative cyclic modulating agent based on cadherin-6 cell adhesion recognition sequence
CFSVESEC

SEQ ID NO: 1074 - protein, 9 aa, Artificial Sequence
  Representative cyclic modulating agent based on cadherin-6 cell adhesion recognition sequence
CFSVESETC

SEQ ID NO: 1075 - protein, 10 aa, Artificial Sequence
  Representative cyclic modulating agent based on cadherin-6 cell adhesion recognition sequence
CFSVESETGC

SEQ ID NO: 1076 - protein, 9 aa, Artificial Sequence
  Representative cyclic modulating agent based on cadherin-6 cell adhesion recognition sequence
CYFSVESEC

SEQ ID NO: 1077 - protein, 10 aa, Artificial Sequence
  Representative cyclic modulating agent based on cadherin-6 cell adhesion recognition sequence
CYFSVESETC

SEQ ID NO: 1078 - protein, 11 aa, Artificial Sequence
  Representative cyclic modulating agent based on cadherin-6 cell adhesion recognition sequence
CYFSVESETGC

SEQ ID NO: 1079 - protein, 5 aa, Artificial Sequence
  Representative cyclic modulating agent based on cadherin-6 cell adhesion recognition sequence
CDSGC

SEQ ID NO: 1080 - protein, 6 aa, Artificial Sequence
  Representative cyclic modulating agent based on cadherin-6 cell adhesion recognition sequence
CDSGNC

SEQ ID NO: 1081 - protein, 7 aa, Artificial Sequence
  Representative cyclic modulating agent based on cadherin-6 cell adhesion recognition sequence
CDSGNGC

SEQ ID NO: 1082 - protein, 6 aa, Artificial Sequence
  Representative cyclic modulating agent based on cadherin-6 cell adhesion recognition sequence
CIDSGC

SEQ ID NO: 1083 - protein, 7 aa, Artificial Sequence
  Representative cyclic modulating agent based on cadherin-6 cell adhesion recognition sequence
CIDSGNC

SEQ ID NO: 1084 - protein, 8 aa, Artificial Sequence
  Representative cyclic modulating agent based on cadherin-6 cell adhesion recognition sequence
CIDSGNGC

SEQ ID NO: 1085 - protein, 7 aa, Artificial Sequence
  Representative cyclic modulating agent based on cadherin-6 cell adhesion recognition sequence
CNIDSGC

SEQ ID NO: 1086 - protein, 8 aa, Artificial Sequence
  Representative cyclic modulating agent based on cadherin-6 cell adhesion recognition sequence
CNIDSGNC

SEQ ID NO: 1087 - protein, 9 aa, Artificial Sequence
  Representative cyclic modulating agent based on cadherin-6 cell adhesion recognition sequence
CNIDSGNGC

SEQ ID NO: 1088 - protein, 8 aa, Artificial Sequence
  Representative cyclic modulating agent based on cadherin-6 cell adhesion recognition sequence
CFNIDSGC

SEQ ID NO: 1089 - protein, 9 aa, Artificial Sequence
  Representative cyclic modulating agent based on cadherin-6 cell adhesion recognition sequence
CFNIDSGNC

SEQ ID NO: 1090 - protein, 10 aa, Artificial Sequence
  Representative cyclic modulating agent based on cadherin-6 cell adhesion recognition sequence
CFNIDSGNGC

SEQ ID NO: 1091 - protein, 9 aa, Artificial Sequence
  Representative cyclic modulating agent based on cadherin-6 cell adhesion recognition sequence
CIFNIDSGC

SEQ ID NO: 1092 - protein, 10 aa, Artificial Sequence
  Representative cyclic modulating agent based on cadherin-6 cell adhesion recognition sequence
CIFNIDSGNC

SEQ ID NO: 1093 - protein, 11 aa, Artificial Sequence
  Representative cyclic modulating agent based on cadherin-6 cell adhesion recognition sequence
CIFNIDSGNGC

SEQ ID NO: 1094 - protein, 5 aa, Artificial Sequence
  Representative cyclic modulating agent based on cadherin-6 cell adhesion recognition sequence
KEEYD

SEQ ID NO: 1095 - protein, 6 aa, Artificial Sequence
  Representative cyclic modulating agent based on cadherin-6 cell adhesion recognition sequence
KLEEYD

SEQ ID NO: 1096 - protein, 6 aa, Artificial Sequence
  Representative cyclic modulating agent based on cadherin-6 cell adhesion recognition sequence
KEEYTD

SEQ ID NO: 1097 - protein, 7 aa, Artificial Sequence
  Representative cyclic modulating agent based on cadherin-6 cell adhesion recognition sequence
KEEYTGD

SEQ ID NO: 1098 - protein, 7 aa, Artificial Sequence
  Representative cyclic modulating agent based on cadherin-6 cell adhesion recognition sequence
KLEEYTD

SEQ ID NO: 1099 - protein, 8 aa, Artificial Sequence
  Representative cyclic modulating agent based on cadherin-6 cell adhesion recognition sequence
KLEEYTGD

SEQ ID NO: 1100 - protein, 7 aa, Artificial Sequence
  Representative cyclic modulating agent based on cadherin-6 cell adhesion recognition sequence
KLLEEYD

SEQ ID NO: 1101 - protein, 9 aa, Artificial Sequence
  Representative cyclic modulating agent based on cadherin-6 cell adhesion recognition sequence
KLLEEYTGD

SEQ ID NO: 1102 - protein, 8 aa, Artificial Sequence
  Representative cyclic modulating agent based on cadherin-6 cell adhesion recognition sequence
KFLLEEYD

SEQ ID NO: 1103 - protein, 8 aa, Artificial Sequence
  Representative cyclic modulating agent based on cadherin-6 cell adhesion recognition sequence
KLLEEYTD

SEQ ID NO: 1104 - protein, 10 aa, Artificial Sequence
  Representative cyclic modulating agent based on cadherin-6 cell adhesion recognition sequence
KFLLEEYTGD

SEQ ID NO: 1105 - protein, 9 aa, Artificial Sequence
  Representative cyclic modulating agent based on cadherin-6 cell adhesion recognition sequence
KFFLLEEYD

SEQ ID NO: 1106 - protein, 10 aa, Artificial Sequence
  Representative cyclic modulating agent based on cadherin-6 cell adhesion recognition sequence
KFFLLEEYTD

SEQ ID NO: 1107 - protein, 11 aa, Artificial Sequence
  Representative cyclic modulating agent based on cadherin-6 cell adhesion recognition sequence
KFFLLEEYTGD

SEQ ID NO: 1108 - protein, 5 aa, Artificial Sequence
  Representative cyclic modulating agent based on cadherin-6 cell adhesion recognition sequence
KESED

SEQ ID NO: 1109 - protein, 6 aa, Artificial Sequence
  Representative cyclic modulating agent based on cadherin-6 cell adhesion recognition sequence
KESETD

SEQ ID NO: 1110 - protein, 7 aa, Artificial Sequence
  Representative cyclic modulating agent based on cadherin-6 cell adhesion recognition sequence
KESETGD

SEQ ID NO: 1111 - protein, 6 aa, Artificial Sequence
  Representative cyclic modulating agent based on cadherin-6 cell adhesion recognition sequence
KVESED

SEQ ID NO: 1112 - protein, 7 aa, Artificial Sequence
  Representative cyclic modulating agent based on cadherin-6 cell adhesion recognition sequence
KVSESTD

SEQ ID NO: 1113 - protein, 8 aa, Artificial Sequence
  Representative cyclic modulating agent based on cadherin-6 cell adhesion recognition sequence
KVESETGD

SEQ ID NO: 1114 - protein, 7 aa, Artificial Sequence
  Representative cyclic modulating agent based on cadherin-6 cell adhesion recognition sequence
KSVESED

SEQ ID NO: 1115 - protein, 8 aa, Artificial Sequence
  Representative cyclic modulating agent based on cadherin-6 cell adhesion recognition sequence
KSVESETD

SEQ ID NO: 1116 - protein, 9 aa, Artificial Sequence
  Representative cyclic modulating agent based on cadherin-6 cell adhesion recognition sequence
KSVESETGD

SEQ ID NO: 1117 - protein, 8 aa, Artificial Sequence
  Representative cyclic modulating agent based on cadherin-6 cell adhesion recognition sequence
KFSVESED

SEQ ID NO: 1118 - protein, 9 aa, Artificial Sequence
  Representative cyclic modulating agent based on cadherin-6 cell adhesion recognition sequence
KFSVESETD

SEQ ID NO: 1119 - protein, 10 aa, Artificial Sequence
  Representative cyclic modulating agent based on cadherin-6 cell adhesion recognition sequence
KFSVESETGD

SEQ ID NO: 1120 - protein, 9 aa, Artificial Sequence
  Representative cyclic modulating agent based on cadherin-6 cell adhesion recognition sequence
KYFSVESED

SEQ ID NO: 1121 - protein, 10 aa, Artificial Sequence
  Representative cyclic modulating agent based on cadherin-6 cell adhesion recognition sequence
KYFSVESETD

SEQ ID NO: 1122 - protein, 11 aa, Artificial Sequence
  Representative cyclic modulating agent based on cadherin-6 cell adhesion recognition sequence
KYFSVESETGD

SEQ ID NO: 1123 - protein, 5 aa, Artificial Sequence
  Representative cyclic modulating agent based on cadherin-6 cell adhesion recognition sequence
KDSGD

SEQ ID NO: 1124 - protein, 6 aa, Artificial Sequence
  Representative cyclic modulating agent based on cadherin-6 cell adhesion recognition sequence
KDSGND

SEQ ID NO: 1125 - protein, 7 aa, Artificial Sequence
  Representative cyclic modulating agent based on cadherin-6 cell adhesion recognition sequence
KDSGNGD

SEQ ID NO: 1126 - protein, 6 aa, Artificial Sequence
  Representative cyclic modulating agent based on cadherin-6 cell adhesion recognition sequence
KIDSGD

SEQ ID NO: 1127 - protein, 7 aa, Artificial Sequence
  Representative cyclic modulating agent based on cadherin-6 cell adhesion recognition sequence
KIDSGND

SEQ ID NO: 1128 - protein, 8 aa, Artificial Sequence
  Representative cyclic modulating agent based on cadherin-6 cell adhesion recognition sequence
KIDSGNGD

SEQ ID NO: 1129 - protein, 7 aa, Artificial Sequence
  Representative cyclic modulating agent based on cadherin-6 cell adhesion recognition sequence
KNIDSGD

SEQ ID NO: 1130 - protein, 8 aa, Artificial Sequence
  Representative cyclic modulating agent based on cadherin-6 cell adhesion recognition sequence
KNIDSGND

SEQ ID NO: 1131 - protein, 9 aa, Artificial Sequence
  Representative cyclic modulating agent based on cadherin-6 cell adhesion recognition sequence
KNIDSGNGD

SEQ ID NO: 1132 - protein, 8 aa, Artificial Sequence
  Representative cyclic modulating agent based on cadherin-6 cell adhesion recognition sequence
KFNIDSGD

SEQ ID NO: 1133 - protein, 9 aa, Artificial Sequence
  Representative cyclic modulating agent based on cadherin-6 cell adhesion recognition sequence
KFNIDSGND

SEQ ID NO: 1134 - protein, 10 aa, Artificial Sequence
  Representative cyclic modulating agent based on cadherin-6 cell adhesion recognition sequence
KFNIDSGNGD

SEQ ID NO: 1135 - protein, 9 aa, Artificial Sequence
  Representative cyclic modulating agent based on cadherin-6 cell adhesion recognition sequence
KIFNIDSGD

SEQ ID NO: 1136 - protein, 10 aa, Artificial Sequence
  Representative cyclic modulating agent based on cadherin-6 cell adhesion recognition sequence
KIFNIDSGND

SEQ ID NO: 1137 - protein, 11 aa, Artificial Sequence
  Representative cyclic modulating agent based on cadherin-6 cell adhesion recognition sequence
KIFNIDSGNGD

SEQ ID NO: 1138 - protein, 5 aa, Artificial Sequence
  Representative cyclic modulating agent based on cadherin-6 cell adhesion recognition sequence
EEEYK

SEQ ID NO: 1139 - protein, 6 aa, Artificial Sequence
  Representative cyclic modulating agent based on cadherin-6 cell adhesion recognition sequence
EEEYTK

SEQ ID NO: 1140 - protein, 7 aa, Artificial Sequence
  Representative cyclic modulating agent based on cadherin-6 cell adhesion recognition sequence
EEEYTGK

SEQ ID NO: 1141 - protein, 6 aa, Artificial Sequence
  Representative cyclic modulating agent based on cadherin-6 cell adhesion recognition sequence
ELEEYK

SEQ ID NO: 1142 - protein, 6 aa, Artificial Sequence
  Representative cyclic modulating agent based on cadherin-6 cell adhesion recognition sequence
EEEYTK

SEQ ID NO: 1143 - protein, 8 aa, Artificial Sequence
  Representative cyclic modulating agent based on cadherin-6 cell adhesion recognition sequence
ELEEYTGK

SEQ ID NO: 1144 - protein, 7 aa, Artificial Sequence
  Representative cyclic modulating agent based on cadherin-6 cell adhesion recognition sequence
ELLEEYK

SEQ ID NO: 1145 - protein, 9 aa, Artificial Sequence
  Representative cyclic modulating agent based on cadherin-6 cell adhesion recognition sequence
ELLEEYTGK

SEQ ID NO: 1146 - protein, 8 aa, Artificial Sequence
  Representative cyclic modulating agent based on cadherin-6 cell adhesion recognition sequence
EFLLEEYK

SEQ ID NO: 1147 - protein, 8 aa, Artificial Sequence
  Representative cyclic modulating agent based on cadherin-6 cell adhesion recognition sequence
ELLEEYTK

SEQ ID NO: 1148 - protein, 10 aa, Artificial Sequence
  Representative cyclic modulating agent based on cadherin-6 cell adhesion recognition sequence
EFLLEEYTGK

SEQ ID NO: 1149 - protein, 9 aa, Artificial Sequence
  Representative cyclic modulating agent based on cadherin-6 cell adhesion recognition sequence
EFFLLEEYK

SEQ ID NO: 1150 - protein, 10 aa, Artificial Sequence
  Representative cyclic modulating agent based on cadherin-6 cell adhesion recognition sequence
EFFLLEEYTK

SEQ ID NO: 1151 - protein, 11 aa, Artificial Sequence
  Representative cyclic modulating agent based on cadherin-6 cell adhesion recognition sequence
EFFLLEEYTGK

SEQ ID NO: 1152 - protein, 5 aa, Artificial Sequence
  Representative cyclic modulating agent based on cadherin-6 cell adhesion recognition sequence
EESEK

SEQ ID NO: 1153 - protein, 6 aa, Artificial Sequence
  Representative cyclic modulating agent based on cadherin-6 cell adhesion recognition sequence
EESETK

SEQ ID NO: 1154 - protein, 7 aa, Artificial Sequence
  Representative cyclic modulating agent based on cadherin-6 cell adhesion recognition sequence
EESETGK

SEQ ID NO: 1155 - protein, 6 aa, Artificial Sequence
  Representative cyclic modulating agent based on cadherin-6 cell adhesion recognition sequence
EVESEK

SEQ ID NO: 1156 - protein, 7 aa, Artificial Sequence
  Representative cyclic modulating agent based on cadherin-6 cell adhesion recognition sequence
EVSESTK

SEQ ID NO: 1157 - protein, 8 aa, Artificial Sequence
  Representative cyclic modulating agent based on cadherin-6 cell adhesion recognition sequence
EVESETGK

SEQ ID NO: 1158 - protein, 7 aa, Artificial Sequence
  Representative cyclic modulating agent based on cadherin-6 cell adhesion recognition sequence
ESVESEK

SEQ ID NO: 1159 - protein, 8 aa, Artificial Sequence
  Representative cyclic modulating agent based on cadherin-6 cell adhesion recognition sequence
ESVESETK

SEQ ID NO: 1160 - protein, 9 aa, Artificial Sequence
  Representative cyclic modulating agent based on cadherin-6 cell adhesion recognition sequence
ESVESETGK

SEQ ID NO: 1161 - protein, 8 aa, Artificial Sequence
  Representative cyclic modulating agent based on cadherin-6 cell adhesion recognition sequence
EFSVESEK

SEQ ID NO: 1162 - protein, 9 aa, Artificial Sequence
  Representative cyclic modulating agent based on cadherin-6 cell adhesion recognition sequence
EFSVESETK

SEQ ID NO: 1163 - protein, 10 aa, Artificial Sequence
  Representative cyclic modulating agent based on cadherin-6 cell adhesion recognition sequence
EFSVESETGK

SEQ ID NO: 1164 - protein, 9 aa, Artificial Sequence
  Representative cyclic modulating agent based on cadherin-6 cell adhesion recognition sequence
EYFSVESEK

SEQ ID NO: 1165 - protein, 10 aa, Artificial Sequence
  Representative cyclic modulating agent based on cadherin-6 cell adhesion recognition sequence
EYFSVESETK

SEQ ID NO: 1166 - protein, 11 aa, Artificial Sequence
  Representative cyclic modulating agent based on cadherin-6 cell adhesion recognition sequence
EYFSVESETGK

SEQ ID NO: 1167 - protein, 5 aa, Artificial Sequence
  Representative cyclic modulating agent based on cadherin-6 cell adhesion recognition sequence
EDSGK

SEQ ID NO: 1168 - protein, 6 aa, Artificial Sequence
  Representative cyclic modulating agent based on cadherin-6 cell adhesion recognition sequence
EDSGNK

SEQ ID NO: 1169 - protein, 7 aa, Artificial Sequence
  Representative cyclic modulating agent based on cadherin-6 cell adhesion recognition sequence
EDSGNGK

SEQ ID NO: 1170 - protein, 6 aa, Artificial Sequence
  Representative cyclic modulating agent based on cadherin-6 cell adhesion recognition sequence
EIDSGK

SEQ ID NO: 1171 - protein, 7 aa, Artificial Sequence
  Representative cyclic modulating agent based on cadherin-6 cell adhesion recognition sequence
EIDSGNK

SEQ ID NO: 1172 - protein, 8 aa, Artificial Sequence
  Representative cyclic modulating agent based on cadherin-6 cell adhesion recognition sequence
EIDSGNGK

SEQ ID NO: 1173 - protein, 7 aa, Artificial Sequence
  Representative cyclic modulating agent based on cadherin-6 cell adhesion recognition sequence
ENIDSGK

SEQ ID NO: 1174 - protein, 8 aa, Artificial Sequence
  Representative cyclic modulating agent based on cadherin-6 cell adhesion recognition sequence
ENIDSGNK

SEQ ID NO: 1175 - protein, 9 aa, Artificial Sequence
  Representative cyclic modulating agent based on cadherin-6 cell adhesion recognition sequence
ENIDSGNGK

SEQ ID NO: 1176 - protein, 8 aa, Artificial Sequence
  Representative cyclic modulating agent based on cadherin-6 cell adhesion recognition sequence
EFNIDSGK

SEQ ID NO: 1177 - protein, 9 aa, Artificial Sequence
  Representative cyclic modulating agent based on cadherin-6 cell adhesion recognition sequence
EFNIDSGNK

SEQ ID NO: 1178 - protein, 10 aa, Artificial Sequence
  Representative cyclic modulating agent based on cadherin-6 cell adhesion recognition sequence
EFNIDSGNGK

SEQ ID NO: 1179 - protein, 9 aa, Artificial Sequence
  Representative cyclic modulating agent based on cadherin-6 cell adhesion recognition sequence
EIFNIDSGK

SEQ ID NO: 1180 - protein, 10 aa, Artificial Sequence
  Representative cyclic modulating agent based on cadherin-6 cell adhesion recognition sequence
EIFNIDSGNK

SEQ ID NO: 1181 - protein, 11 aa, Artificial Sequence
  Representative cyclic modulating agent based on cadherin-6 cell adhesion recognition sequence
EIFNIDSGNGK

SEQ ID NO: 1182 - protein, 5 aa, Artificial Sequence
  Representative cyclic modulating agent based on cadherin-6 cell adhesion recognition sequence
DEEYK

SEQ ID NO: 1183 - protein, 6 aa, Artificial Sequence
  Representative cyclic modulating agent based on cadherin-6 cell adhesion recognition sequence
DLEEYK

SEQ ID NO: 1184 - protein, 7 aa, Artificial Sequence
  Representative cyclic modulating agent based on cadherin-6 cell adhesion recognition sequence
DLEEYTK

SEQ ID NO: 1185 - protein, 8 aa, Artificial Sequence
  Representative cyclic modulating agent based on cadherin-6 cell adhesion recognition sequence
DLEEYTGK

SEQ ID NO: 1186 - protein, 7 aa, Artificial Sequence
  Representative cyclic modulating agent based on cadherin-6 cell adhesion recognition sequence
DLLEEYK

SEQ ID NO: 1187 - protein, 9 aa, Artificial Sequence
  Representative cyclic modulating agent based on cadherin-6 cell adhesion recognition sequence
DLLEEYTGK

SEQ ID NO: 1188 - protein, 8 aa, Artificial Sequence
  Representative cyclic modulating agent based on cadherin-6 cell adhesion recognition sequence
DFLLEEYK

SEQ ID NO: 1189 - protein, 8 aa, Artificial Sequence
  Representative cyclic modulating agent based on cadherin-6 cell adhesion recognition sequence
DLLEEYTK

SEQ ID NO: 1190 - protein, 10 aa, Artificial Sequence
  Representative cyclic modulating agent based on cadherin-6 cell adhesion recognition sequence
DFLLEEYTGK

SEQ ID NO: 1191 - protein, 9 aa, Artificial Sequence
  Representative cyclic modulating agent based on cadherin-6 cell adhesion recognition sequence
DFFLLEEYK

SEQ ID NO: 1192 - protein, 10 aa, Artificial Sequence
  Representative cyclic modulating agent based on cadherin-6 cell adhesion recognition sequence
DFFLLEEYTK

SEQ ID NO: 1193 - protein, 11 aa, Artificial Sequence
  Representative cyclic modulating agent based on cadherin-6 cell adhesion recognition sequence
DFFLLEEYTGK

SEQ ID NO: 1194 - protein, 5 aa, Artificial Sequence
  Representative cyclic modulating agent based on cadherin-6 cell adhesion recognition sequence
DESEK

SEQ ID NO: 1195 - protein, 6 aa, Artificial Sequence
  Representative cyclic modulating agent based on cadherin-6 cell adhesion recognition sequence
DESETK

SEQ ID NO: 1196 - protein, 7 aa, Artificial Sequence
  Representative cyclic modulating agent based on cadherin-6 cell adhesion recognition sequence
DESETGK

SEQ ID NO: 1197 - protein, 6 aa, Artificial Sequence
  Representative cyclic modulating agent based on cadherin-6 cell adhesion recognition sequence
DVESEK

SEQ ID NO: 1198 - protein, 7 aa, Artificial Sequence
  Representative cyclic modulating agent based on cadherin-6 cell adhesion recognition sequence
DVSESTK

SEQ ID NO: 1199 - protein, 8 aa, Artificial Sequence
  Representative cyclic modulating agent based on cadherin-6 cell adhesion recognition sequence
DVESETGK

SEQ ID NO: 1200 - protein, 7 aa, Artificial Sequence
  Representative cyclic modulating agent based on cadherin-6 cell adhesion recognition sequence
DSVESEK

SEQ ID NO: 1201 - protein, 8 aa, Artificial Sequence
  Representative cyclic modulating agent based on cadherin-6 cell adhesion recognition sequence
DSVESETK

SEQ ID NO: 1202 - protein, 9 aa, Artificial Sequence
  Representative cyclic modulating agent based on cadherin-6 cell adhesion recognition sequence
DSVESETGK

SEQ ID NO: 1203 - protein, 8 aa, Artificial Sequence
  Representative cyclic modulating agent based on cadherin-6 cell adhesion recognition sequence
DFSVESEK

SEQ ID NO: 1204 - protein, 9 aa, Artificial Sequence
  Representative cyclic modulating agent based on cadherin-6 cell adhesion recognition sequence
DFSVESETK

SEQ ID NO: 1205 - protein, 10 aa, Artificial Sequence
  Representative cyclic modulating agent based on cadherin-6 cell adhesion recognition sequence
DFSVESETGK

SEQ ID NO: 1206 - protein, 9 aa, Artificial Sequence
  Representative cyclic modulating agent based on cadherin-6 cell adhesion recognition sequence
DYFSVESEK

SEQ ID NO: 1207 - protein, 10 aa, Artificial Sequence
  Representative cyclic modulating agent based on cadherin-6 cell adhesion recognition sequence
DYFSVESETK

SEQ ID NO: 1208 - protein, 11 aa, Artificial Sequence
  Representative cyclic modulating agent based on cadherin-6 cell adhesion recognition sequence
DYFSVESETGK

SEQ ID NO: 1209 - protein, 5 aa, Artificial Sequence
  Representative cyclic modulating agent based on cadherin-6 cell adhesion recognition sequence
DDSGK

SEQ ID NO: 1210 - protein, 6 aa, Artificial Sequence
  Representative cyclic modulating agent based on cadherin-6 cell adhesion recognition sequence
DDSGNK

SEQ ID NO: 1211 - protein, 7 aa, Artificial Sequence
  Representative cyclic modulating agent based on cadherin-6 cell adhesion recognition sequence
DDSGNGK

SEQ ID NO: 1212 - protein, 6 aa, Artificial Sequence
  Representative cyclic modulating agent based on cadherin-6 cell adhesion recognition sequence
DIDSGK

SEQ ID NO: 1213 - protein, 7 aa, Artificial Sequence
  Representative cyclic modulating agent based on cadherin-6 cell adhesion recognition sequence
DIDSGNK

SEQ ID NO: 1214 - protein, 8 aa, Artificial Sequence
  Representative cyclic modulating agent based on cadherin-6 cell adhesion recognition sequence
DIDSGNGK

SEQ ID NO: 1215 - protein, 7 aa, Artificial Sequence
  Representative cyclic modulating agent based on cadherin-6 cell adhesion recognition sequence
DNIDSGK

SEQ ID NO: 1216 - protein, 8 aa, Artificial Sequence
  Representative cyclic modulating agent based on cadherin-6 cell adhesion recognition sequence
DNIDSGNK

SEQ ID NO: 1217 - protein, 9 aa, Artificial Sequence
  Representative cyclic modulating agent based on cadherin-6 cell adhesion recognition sequence
DNIDSGNGK

SEQ ID NO: 1218 - protein, 8 aa, Artificial Sequence
  Representative cyclic modulating agent based on cadherin-6 cell adhesion recognition sequence
DFNIDSGK

SEQ ID NO: 1219 - protein, 9 aa, Artificial Sequence
  Representative cyclic modulating agent based on cadherin-6 cell adhesion recognition sequence
DFNIDSGNK

SEQ ID NO: 1220 - protein, 10 aa, Artificial Sequence
  Representative cyclic modulating agent based on cadherin-6 cell adhesion recognition sequence
DFNIDSGNGK

SEQ ID NO: 1221 - protein, 9 aa, Artificial Sequence
  Representative cyclic modulating agent based on cadherin-6 cell adhesion recognition sequence
DIFNIDSGK

SEQ ID NO: 1222 - protein, 10 aa, Artificial Sequence
  Representative cyclic modulating agent based on cadherin-6 cell adhesion recognition sequence
DIFNIDSGNK

SEQ ID NO: 1223 - protein, 11 aa, Artificial Sequence
  Representative cyclic modulating agent based on cadherin-6 cell adhesion recognition sequence
DIFNIDSGNGK

SEQ ID NO: 1224 - protein, 5 aa, Artificial Sequence
  Representative cyclic modulating agent based on cadherin-6 cell adhesion recognition sequence
KEEYE

SEQ ID NO: 1225 - protein, 6 aa, Artificial Sequence
  Representative cyclic modulating agent based on cadherin-6 cell adhesion recognition sequence
KLEEYE

SEQ ID NO: 1226 - protein, 7 aa, Artificial Sequence
  Representative cyclic modulating agent based on cadherin-6 cell adhesion recognition sequence
KLEEYTE

SEQ ID NO: 1227 - protein, 8 aa, Artificial Sequence
  Representative cyclic modulating agent based on cadherin-6 cell adhesion recognition sequence
KLEEYTGE

SEQ ID NO: 1228 - protein, 7 aa, Artificial Sequence
  Representative cyclic modulating agent based on cadherin-6 cell adhesion recognition sequence
KLLEEYE

SEQ ID NO: 1229 - protein, 9 aa, Artificial Sequence
  Representative cyclic modulating agent based on cadherin-6 cell adhesion recognition sequence
KLLEEYTGE

SEQ ID NO: 1230 - protein, 8 aa, Artificial Sequence
  Representative cyclic modulating agent based on cadherin-6 cell adhesion recognition sequence
KFLLEEYE

SEQ ID NO: 1231 - protein, 8 aa, Artificial Sequence
  Representative cyclic modulating agent based on cadherin-6 cell adhesion recognition sequence
KLLEEYTE

SEQ ID NO: 1232 - protein, 10 aa, Artificial Sequence
  Representative cyclic modulating agent based on cadherin-6 cell adhesion recognition sequence
KFLLEEYTGE

SEQ ID NO: 1233 - protein, 9 aa, Artificial Sequence
  Representative cyclic modulating agent based on cadherin-6 cell adhesion recognition sequence
KFFLLEEYE

SEQ ID NO: 1234 - protein, 10 aa, Artificial Sequence
  Representative cyclic modulating agent based on cadherin-6 cell adhesion recognition sequence
KFFLLEEYTE

SEQ ID NO: 1235 - protein, 11 aa, Artificial Sequence
  Representative cyclic modulating agent based on cadherin-6 cell adhesion recognition sequence
KFFLLEEYTGE

SEQ ID NO: 1236 - protein, 5 aa, Artificial Sequence
  Representative cyclic modulating agent based on cadherin-6 cell adhesion recognition sequence
KNENE

SEQ ID NO: 1237 - protein, 6 aa, Artificial Sequence
  Representative cyclic modulating agent based on cadherin-6 cell adhesion recognition sequence
KNENTE

SEQ ID NO: 1238 - protein, 8 aa, Artificial Sequence
  Representative cyclic modulating agent based on cadherin-6 cell adhesion recognition sequence
KINENTGE

SEQ ID NO: 1239 - protein, 5 aa, Artificial Sequence
  Representative cyclic modulating agent based on cadherin-6 cell adhesion recognition sequence
KESEE

SEQ ID NO: 1240 - protein, 6 aa, Artificial Sequence
  Representative cyclic modulating agent based on cadherin-6 cell adhesion recognition sequence
KESETE

SEQ ID NO: 1241 - protein, 7 aa, Artificial Sequence
  Representative cyclic modulating agent based on cadherin-6 cell adhesion recognition sequence
KESETGE

SEQ ID NO: 1242 - protein, 6 aa, Artificial Sequence
  Representative cyclic modulating agent based on cadherin-6 cell adhesion recognition sequence
KVESEE

SEQ ID NO: 1243 - protein, 7 aa, Artificial Sequence
  Representative cyclic modulating agent based on cadherin-6 cell adhesion recognition sequence
KVSESTE

SEQ ID NO: 1244 - protein, 8 aa, Artificial Sequence
  Representative cyclic modulating agent based on cadherin-6 cell adhesion recognition sequence
KVESETGE

SEQ ID NO: 1245 - protein, 7 aa, Artificial Sequence
  Representative cyclic modulating agent based on cadherin-6 cell adhesion recognition sequence
KSVESEE

SEQ ID NO: 1246 - protein, 8 aa, Artificial Sequence
  Representative cyclic modulating agent based on cadherin-6 cell adhesion recognition sequence
KSVESETE

SEQ ID NO: 1247 - protein, 9 aa, Artificial Sequence
  Representative cyclic modulating agent based on cadherin-6 cell adhesion recognition sequence
KSVESETGE

SEQ ID NO: 1248 - protein, 8 aa, Artificial Sequence
  Representative cyclic modulating agent based on cadherin-6 cell adhesion recognition sequence
KFSVESEE

SEQ ID NO: 1249 - protein, 9 aa, Artificial Sequence
  Representative cyclic modulating agent based on cadherin-6 cell adhesion recognition sequence
KFSVESETE

SEQ ID NO: 1250 - protein, 10 aa, Artificial Sequence
  Representative cyclic modulating agent based on cadherin-6 cell adhesion recognition sequence
KFSVESETGE

SEQ ID NO: 1251 - protein, 9 aa, Artificial Sequence
  Representative cyclic modulating agent based on cadherin-6 cell adhesion recognition sequence
KYFSVESEE

SEQ ID NO: 1252 - protein, 10 aa, Artificial Sequence
  Representative cyclic modulating agent based on cadherin-6 cell adhesion recognition sequence
KYFSVESETE

SEQ ID NO: 1253 - protein, 11 aa, Artificial Sequence
  Representative cyclic modulating agent based on cadherin-6 cell adhesion recognition sequence
KYFSVESETGE

SEQ ID NO: 1254 - protein, 5 aa, Artificial Sequence
  Representative cyclic modulating agent based on cadherin-6 cell adhesion recognition sequence
KDSGE

SEQ ID NO: 1255 - protein, 6 aa, Artificial Sequence
  Representative cyclic modulating agent based on cadherin-6 cell adhesion recognition sequence
KDSGNE

SEQ ID NO: 1256 - protein, 7 aa, Artificial Sequence
  Representative cyclic modulating agent based on cadherin-6 cell adhesion recognition sequence
KDSGNGE

SEQ ID NO: 1257 - protein, 6 aa, Artificial Sequence
  Representative cyclic modulating agent based on cadherin-6 cell adhesion recognition sequence
KIDSGE

SEQ ID NO: 1258 - protein, 7 aa, Artificial Sequence
  Representative cyclic modulating agent based on cadherin-6 cell adhesion recognition sequence
KIDSGNE

SEQ ID NO: 1259 - protein, 8 aa, Artificial Sequence
  Representative cyclic modulating agent based on cadherin-6 cell adhesion recognition sequence
KIDSGNGE

SEQ ID NO: 1260 - protein, 7 aa, Artificial Sequence
  Representative cyclic modulating agent based on cadherin-6 cell adhesion recognition sequence
KNIDSGE

SEQ ID NO: 1261 - protein, 8 aa, Artificial Sequence
  Representative cyclic modulating agent based on cadherin-6 cell adhesion recognition sequence
KNIDSGNE

SEQ ID NO: 1262 - protein, 9 aa, Artificial Sequence
  Representative cyclic modulating agent based on cadherin-6 cell adhesion recognition sequence
KNIDSGNGE

SEQ ID NO: 1263 - protein, 8 aa, Artificial Sequence
  Representative cyclic modulating agent based on cadherin-6 cell adhesion recognition sequence
KFNIDSGE

SEQ ID NO: 1264 - protein, 9 aa, Artificial Sequence
  Representative cyclic modulating agent based on cadherin-6 cell adhesion recognition sequence
KFNIDSGNE

SEQ ID NO: 1265 - protein, 10 aa, Artificial Sequence
  Representative cyclic modulating agent based on cadherin-6 cell adhesion recognition sequence
KFNIDSGNGE

SEQ ID NO: 1266 - protein, 9 aa, Artificial Sequence
  Representative cyclic modulating agent based on cadherin-6 cell adhesion recognition sequence
KIFNIDSGE

SEQ ID NO: 1267 - protein, 10 aa, Artificial Sequence
  Representative cyclic modulating agent based on cadherin-6 cell adhesion recognition sequence
KIFNIDSGNE

SEQ ID NO: 1268 - protein, 11 aa, Artificial Sequence
  Representative cyclic modulating agent based on cadherin-6 cell adhesion recognition sequence
KIFNIDSGNGE

SEQ ID NO: 1269 - protein, 5 aa, Artificial Sequence
  Representative cyclic modulating agent based on cadherin-6 cell adhesion recognition sequence
LEEYT

SEQ ID NO: 1270 - protein, 6 aa, Artificial Sequence
  Representative cyclic modulating agent based on cadherin-6 cell adhesion recognition sequence
LEEYTG

SEQ ID NO: 1271 - protein, 5 aa, Artificial Sequence
  Representative cyclic modulating agent based on cadherin-6 cell adhesion recognition sequence
LLEEY

SEQ ID NO: 1272 - protein, 7 aa, Artificial Sequence
  Representative cyclic modulating agent based on cadherin-6 cell adhesion recognition sequence
LLEEYTG

SEQ ID NO: 1273 - protein, 6 aa, Artificial Sequence
  Representative cyclic modulating agent based on cadherin-6 cell adhesion recognition sequence
FLLEEY

SEQ ID NO: 1274 - protein, 6 aa, Artificial Sequence
  Representative cyclic modulating agent based on cadherin-6 cell adhesion recognition sequence
LLEEYT

SEQ ID NO: 1275 - protein, 8 aa, Artificial Sequence
  Representative cyclic modulating agent based on cadherin-6 cell adhesion recognition sequence
FLLEEYTG

SEQ ID NO: 1276 - protein, 7 aa, Artificial Sequence
  Representative cyclic modulating agent based on cadherin-6 cell adhesion recognition sequence
FFLLEEY

SEQ ID NO: 1277 - protein, 8 aa, Artificial Sequence
  Representative cyclic modulating agent based on cadherin-6 cell adhesion recognition sequence
FFLLEEYT

SEQ ID NO: 1278 - protein, 9 aa, Artificial Sequence
  Representative cyclic modulating agent based on cadherin-6 cell adhesion recognition sequence
FFLLEEYTG

SEQ ID NO: 1279 - protein, 5 aa, Artificial Sequence
  Representative cyclic modulating agent based on cadherin-6 cell adhesion recognition sequence
ESETG

SEQ ID NO: 1280 - protein, 5 aa, Artificial Sequence
  Representative cyclic modulating agent based on cadherin-6 cell adhesion recognition sequence
VSEST

SEQ ID NO: 1281 - protein, 6 aa, Artificial Sequence
  Representative cyclic modulating agent based on cadherin-6 cell adhesion recognition sequence
VESETG

SEQ ID NO: 1282 - protein, 5 aa, Artificial Sequence
  Representative cyclic modulating agent based on cadherin-6 cell adhesion recognition sequence
SVESE

SEQ ID NO: 1283 - protein, 6 aa, Artificial Sequence
  Representative cyclic modulating agent based on cadherin-6 cell adhesion recognition sequence
SVESET

SEQ ID NO: 1284 - protein, 7 aa, Artificial Sequence
  Representative cyclic modulating agent based on cadherin-6 cell adhesion recognition sequence
SVESETG

SEQ ID NO: 1285 - protein, 6 aa, Artificial Sequence
  Representative cyclic modulating agent based on cadherin-6 cell adhesion recognition sequence
FSVESE

SEQ ID NO: 1286 - protein, 7 aa, Artificial Sequence
  Representative cyclic modulating agent based on cadherin-6 cell adhesion recognition sequence
FSVESET

SEQ ID NO: 1287 - protein, 8 aa, Artificial Sequence
  Representative cyclic modulating agent based on cadherin-6 cell adhesion recognition sequence
FSVESETG

SEQ ID NO: 1288 - protein, 7 aa, Artificial Sequence
  Representative cyclic modulating agent based on cadherin-6 cell adhesion recognition sequence
YFSVESE

SEQ ID NO: 1289 - protein, 8 aa, Artificial Sequence
  Representative cyclic modulating agent based on cadherin-6 cell adhesion recognition sequence
YFSVESET

SEQ ID NO: 1290 - protein, 9 aa, Artificial Sequence
  Representative cyclic modulating agent based on cadherin-6 cell adhesion recognition sequence
YFSVESETG

SEQ ID NO: 1291 - protein, 5 aa, Artificial Sequence
  Representative cyclic modulating agent based on cadherin-6 cell adhesion recognition sequence
DSGNG

SEQ ID NO: 1292 - protein, 5 aa, Artificial Sequence
  Representative cyclic modulating agent based on cadherin-6 cell adhesion recognition sequence
IDSGN

SEQ ID NO: 1293 - protein, 6 aa, Artificial Sequence
  Representative cyclic modulating agent based on cadherin-6 cell adhesion recognition sequence
IDSGNG

SEQ ID NO: 1294 - protein, 5 aa, Artificial Sequence
  Representative cyclic modulating agent based on cadherin-6 cell adhesion recognition sequence
NIDSG

SEQ ID NO: 1295 - protein, 6 aa, Artificial Sequence
  Representative cyclic modulating agent based on cadherin-6 cell adhesion recognition sequence
NIDSGN

SEQ ID NO: 1296 - protein, 7 aa, Artificial Sequence
  Representative cyclic modulating agent based on cadherin-6 cell adhesion recognition sequence
NIDSGNG

SEQ ID NO: 1297 - protein, 6 aa, Artificial Sequence
  Representative cyclic modulating agent based on cadherin-6 cell adhesion recognition sequence
FNIDSG

SEQ ID NO: 1298 - protein, 7 aa, Artificial Sequence
  Representative cyclic modulating agent based on cadherin-6 cell adhesion recognition sequence
FNIDSGN

SEQ ID NO: 1299 - protein, 8 aa, Artificial Sequence
  Representative cyclic modulating agent based on cadherin-6 cell adhesion recognition sequence
FNIDSGNG

SEQ ID NO: 1300 - protein, 7 aa, Artificial Sequence
  Representative cyclic modulating agent based on cadherin-6 cell adhesion recognition sequence
IFNIDSG

SEQ ID NO: 1301 - protein, 8 aa, Artificial Sequence
  Representative cyclic modulating agent based on cadherin-6 cell adhesion recognition sequence
IFNIDSGN

SEQ ID NO: 1302 - protein, 9 aa, Artificial Sequence
  Representative cyclic modulating agent based on cadherin-6 cell adhesion recognition sequence
IFNIDSGNG

SEQ ID NO: 1303 - protein, 5 aa, Artificial Sequence
  Representative cyclic modulating agent based on cadherin-7 cell adhesion recognition sequence
CDENC

SEQ ID NO: 1304 - protein, 6 aa, Artificial Sequence
  Representative cyclic modulating agent based on cadherin-7 cell adhesion recognition sequence
CIDENC

SEQ ID NO: 1305 - protein, 6 aa, Artificial Sequence
  Representative cyclic modulating agent based on cadherin-7 cell adhesion recognition sequence
CDENTC

SEQ ID NO: 1306 - protein, 7 aa, Artificial Sequence
  Representative cyclic modulating agent based on cadherin-7 cell adhesion recognition sequence
CIIDENC

SEQ ID NO: 1307 - protein, 7 aa, Artificial Sequence
  Representative cyclic modulating agent based on cadherin-7 cell adhesion recognition sequence
CIDENTC

SEQ ID NO: 1308 - protein, 8 aa, Artificial Sequence
  Representative cyclic modulating agent based on cadherin-7 cell adhesion recognition sequence
CIIDENTC

SEQ ID NO: 1309 - protein, 7 aa, Artificial Sequence
  Representative cyclic modulating agent based on cadherin-7 cell adhesion recognition sequence
CDENTGC

SEQ ID NO: 1310 - protein, 8 aa, Artificial Sequence
  Representative cyclic modulating agent based on cadherin-7 cell adhesion recognition sequence
CIDENTGC

SEQ ID NO: 1311 - protein, 9 aa, Artificial Sequence
  Representative cyclic modulating agent based on cadherin-7 cell adhesion recognition sequence
CIIDENTGC

SEQ ID NO: 1312 - protein, 8 aa, Artificial Sequence
  Representative cyclic modulating agent based on cadherin-7 cell adhesion recognition sequence
CFIIDENC

SEQ ID NO: 1313 - protein, 9 aa, Artificial Sequence
  Representative cyclic modulating agent based on cadherin-7 cell adhesion recognition sequence
CFIIDENTC

SEQ ID NO: 1314 - protein, 10 aa, Artificial Sequence
  Representative cyclic modulating agent based on cadherin-7 cell adhesion recognition sequence
CFIIDENTGC

SEQ ID NO: 1315 - protein, 9 aa, Artificial Sequence
  Representative cyclic modulating agent based on cadherin-7 cell adhesion recognition sequence
CIFIIDENC

SEQ ID NO: 1316 - protein, 10 aa, Artificial Sequence
  Representative cyclic modulating agent based on cadherin-7 cell adhesion recognition sequence
CIFIIDENTC

SEQ ID NO: 1317 - protein, 11 aa, Artificial Sequence
  Representative cyclic modulating agent based on cadherin-7 cell adhesion recognition sequence
CIFIIDENTGC

SEQ ID NO: 1318 - protein, 6 aa, Artificial Sequence
  Representative cyclic modulating agent based on cadherin-7 cell adhesion recognition sequence
DDENTK

SEQ ID NO: 1319 - protein, 5 aa, Artificial Sequence
  Representative cyclic modulating agent based on cadherin-7 cell adhesion recognition sequence
DDENK

SEQ ID NO: 1320 - protein, 6 aa, Artificial Sequence
  Representative cyclic modulating agent based on cadherin-7 cell adhesion recognition sequence
DIDENK

SEQ ID NO: 1321 - protein, 7 aa, Artificial Sequence
  Representative cyclic modulating agent based on cadherin-7 cell adhesion recognition sequence
DIIDENK

SEQ ID NO: 1322 - protein, 8 aa, Artificial Sequence
  Representative cyclic modulating agent based on cadherin-7 cell adhesion recognition sequence
DFIIDENK

SEQ ID NO: 1323 - protein, 9 aa, Artificial Sequence
  Representative cyclic modulating agent based on cadherin-7 cell adhesion recognition sequence
DIFIIDENK

SEQ ID NO: 1324 - protein, 5 aa, Artificial Sequence
  Representative cyclic modulating agent based on cadherin-7 cell adhesion recognition sequence
EDENK

SEQ ID NO: 1325 - protein, 6 aa, Artificial Sequence
  Representative cyclic modulating agent based on cadherin-7 cell adhesion recognition sequence
EIDENK

SEQ ID NO: 1326 - protein, 7 aa, Artificial Sequence
  Representative cyclic modulating agent based on cadherin-7 cell adhesion recognition sequence
EIIDENK

SEQ ID NO: 1327 - protein, 8 aa, Artificial Sequence
  Representative cyclic modulating agent based on cadherin-7 cell adhesion recognition sequence
EFIIDENK

SEQ ID NO: 1328 - protein, 9 aa, Artificial Sequence
  Representative cyclic modulating agent based on cadherin-7 cell adhesion recognition sequence
EIFIIDENK

SEQ ID NO: 1329 - protein, 5 aa, Artificial Sequence
  Representative cyclic modulating agent based on cadherin-7 cell adhesion recognition sequence
KDEND

SEQ ID NO: 1330 - protein, 6 aa, Artificial Sequence
  Representative cyclic modulating agent based on cadherin-7 cell adhesion recognition sequence
KIDEND

SEQ ID NO: 1331 - protein, 6 aa, Artificial Sequence
  Representative cyclic modulating agent based on cadherin-7 cell adhesion recognition sequence
KDENTD

SEQ ID NO: 1332 - protein, 7 aa, Artificial Sequence
  Representative cyclic modulating agent based on cadherin-7 cell adhesion recognition sequence
KIIDEND

SEQ ID NO: 1333 - protein, 7 aa, Artificial Sequence
  Representative cyclic modulating agent based on cadherin-7 cell adhesion recognition sequence
KIDENTD

SEQ ID NO: 1334 - protein, 8 aa, Artificial Sequence
  Representative cyclic modulating agent based on cadherin-7 cell adhesion recognition sequence
KIIDENTD

SEQ ID NO: 1335 - protein, 7 aa, Artificial Sequence
  Representative cyclic modulating agent based on cadherin-7 cell adhesion recognition sequence
KDENTGD

SEQ ID NO: 1336 - protein, 8 aa, Artificial Sequence
  Representative cyclic modulating agent based on cadherin-7 cell adhesion recognition sequence
KIDENTGD

SEQ ID NO: 1337 - protein, 9 aa, Artificial Sequence
  Representative cyclic modulating agent based on cadherin-7 cell adhesion recognition sequence
KIIDENTGD

SEQ ID NO: 1338 - protein, 8 aa, Artificial Sequence
  Representative cyclic modulating agent based on cadherin-7 cell adhesion recognition sequence
KFIIDEND

SEQ ID NO: 1339 - protein, 9 aa, Artificial Sequence
  Representative cyclic modulating agent based on cadherin-7 cell adhesion recognition sequence
KFIIDENTD

SEQ ID NO: 1340 - protein, 10 aa, Artificial Sequence
  Representative cyclic modulating agent based on cadherin-7 cell adhesion recognition sequence
KFIIDENTGD

SEQ ID NO: 1341 - protein, 9 aa, Artificial Sequence
  Representative cyclic modulating agent based on cadherin-7 cell adhesion recognition sequence
KIFIIDEND

SEQ ID NO: 1342 - protein, 10 aa, Artificial Sequence
  Representative cyclic modulating agent based on cadherin-7 cell adhesion recognition sequence
KIFIIDENTD

SEQ ID NO: 1343 - protein, 11 aa, Artificial Sequence
  Representative cyclic modulating agent based on cadherin-7 cell adhesion recognition sequence
KIFIIDENTGD

SEQ ID NO: 1344 - protein, 7 aa, Artificial Sequence
  Representative cyclic modulating agent based on cadherin-7 cell adhesion recognition sequence
DIDENTK

SEQ ID NO: 1345 - protein, 5 aa, Artificial Sequence
  Representative cyclic modulating agent based on cadherin-7 cell adhesion recognition sequence
IDENT

SEQ ID NO: 1346 - protein, 6 aa, Artificial Sequence
  Representative cyclic modulating agent based on cadherin-7 cell adhesion recognition sequence
IIDENT

SEQ ID NO: 1347 - protein, 5 aa, Artificial Sequence
  Representative cyclic modulating agent based on cadherin-7 cell adhesion recognition sequence
DENTG

SEQ ID NO: 1348 - protein, 6 aa, Artificial Sequence
  Representative cyclic modulating agent based on cadherin-7 cell adhesion recognition sequence
IDENTG

SEQ ID NO: 1349 - protein, 5 aa, Artificial Sequence
  Representative cyclic modulating agent based on cadherin-7 cell adhesion recognition sequence
KDENE

SEQ ID NO: 1350 - protein, 6 aa, Artificial Sequence
  Representative cyclic modulating agent based on cadherin-7 cell adhesion recognition sequence
KIDENE

SEQ ID NO: 1351 - protein, 6 aa, Artificial Sequence
  Representative cyclic modulating agent based on cadherin-7 cell adhesion recognition sequence
KDENTE

SEQ ID NO: 1352 - protein, 7 aa, Artificial Sequence
  Representative cyclic modulating agent based on cadherin-7 cell adhesion recognition sequence
KIIDENE

SEQ ID NO: 1353 - protein, 7 aa, Artificial Sequence
  Representative cyclic modulating agent based on cadherin-7 cell adhesion recognition sequence
KIDENTE

SEQ ID NO: 1354 - protein, 8 aa, Artificial Sequence
  Representative cyclic modulating agent based on cadherin-7 cell adhesion recognition sequence
KIIDENTE

SEQ ID NO: 1355 - protein, 7 aa, Artificial Sequence
  Representative cyclic modulating agent based on cadherin-7 cell adhesion recognition sequence
KDENTGE

SEQ ID NO: 1356 - protein, 8 aa, Artificial Sequence
  Representative cyclic modulating agent based on cadherin-7 cell adhesion recognition sequence
KIDENTGE

SEQ ID NO: 1357 - protein, 9 aa, Artificial Sequence
  Representative cyclic modulating agent based on cadherin-7 cell adhesion recognition sequence
KIIDENTGE

SEQ ID NO: 1358 - protein, 8 aa, Artificial Sequence
  Representative cyclic modulating agent based on cadherin-7 cell adhesion recognition sequence
KFIIDENE

SEQ ID NO: 1359 - protein, 9 aa, Artificial Sequence
  Representative cyclic modulating agent based on cadherin-7 cell adhesion recognition sequence
KFIIDENTE

SEQ ID NO: 1360 - protein, 10 aa, Artificial Sequence
  Representative cyclic modulating agent based on cadherin-7 cell adhesion recognition sequence
KFIIDENTGE

SEQ ID NO: 1361 - protein, 9 aa, Artificial Sequence
  Representative cyclic modulating agent based on cadherin-7 cell adhesion recognition sequence
KIFIIDENE

SEQ ID NO: 1362 - protein, 10 aa, Artificial Sequence
  Representative cyclic modulating agent based on cadherin-7 cell adhesion recognition sequence
KIFIIDENTE

SEQ ID NO: 1363 - protein, 11 aa, Artificial Sequence
  Representative cyclic modulating agent based on cadherin-7 cell adhesion recognition sequence
KIFIIDENTGE

SEQ ID NO: 1364 - protein, 6 aa, Artificial Sequence
  Representative cyclic modulating agent based on cadherin-7 cell adhesion recognition sequence
DDENTK

SEQ ID NO: 1365 - protein, 5 aa, Artificial Sequence
  Representative cyclic modulating agent based on cadherin-7 cell adhesion recognition sequence
IIDEN

SEQ ID NO: 1366 - protein, 7 aa, Artificial Sequence
  Representative cyclic modulating agent based on cadherin-7 cell adhesion recognition sequence
IIDENTG

SEQ ID NO: 1367 - protein, 6 aa, Artificial Sequence
  Representative cyclic modulating agent based on cadherin-7 cell adhesion recognition sequence
FIIDEN

SEQ ID NO: 1368 - protein, 7 aa, Artificial Sequence
  Representative cyclic modulating agent based on cadherin-7 cell adhesion recognition sequence
FIIDENT

SEQ ID NO: 1369 - protein, 8 aa, Artificial Sequence
  Representative cyclic modulating agent based on cadherin-7 cell adhesion recognition sequence
FIIDENTG

SEQ ID NO: 1370 - protein, 7 aa, Artificial Sequence
  Representative cyclic modulating agent based on cadherin-7 cell adhesion recognition sequence
IFIIDEN

SEQ ID NO: 1371 - protein, 8 aa, Artificial Sequence
  Representative cyclic modulating agent based on cadherin-7 cell adhesion recognition sequence
IFIIDENT

SEQ ID NO: 1372 - protein, 9 aa, Artificial Sequence
  Representative cyclic modulating agent based on cadherin-7 cell adhesion recognition sequence
IFIIDENTG

SEQ ID NO: 1373 - protein, 5 aa, Artificial Sequence
  Representative cyclic modulating agent based on cadherin-7 cell adhesion recognition sequence
CEPKC

SEQ ID NO: 1374 - protein, 6 aa, Artificial Sequence
  Representative cyclic modulating agent based on cadherin-7 cell adhesion recognition sequence
CEPKTC

SEQ ID NO: 1375 - protein, 7 aa, Artificial Sequence
  Representative cyclic modulating agent based on cadherin-7 cell adhesion recognition sequence
CEPKTGC

SEQ ID NO: 1376 - protein, 6 aa, Artificial Sequence
  Representative cyclic modulating agent based on cadherin-7 cell adhesion recognition sequence
CVEPKC

SEQ ID NO: 1377 - protein, 7 aa, Artificial Sequence
  Representative cyclic modulating agent based on cadherin-7 cell adhesion recognition sequence
CVEPKTC

SEQ ID NO: 1378 - protein, 8 aa, Artificial Sequence
  Representative cyclic modulating agent based on cadherin-7 cell adhesion recognition sequence
CVEPKTGC

SEQ ID NO: 1379 - protein, 7 aa, Artificial Sequence
  Representative cyclic modulating agent based on cadherin-7 cell adhesion recognition sequence
CSVEPKC

SEQ ID NO: 1380 - protein, 8 aa, Artificial Sequence
  Representative cyclic modulating agent based on cadherin-7 cell adhesion recognition sequence
CSVEPKTC

SEQ ID NO: 1381 - protein, 9 aa, Artificial Sequence
  Representative cyclic modulating agent based on cadherin-7 cell adhesion recognition sequence
CSVEPKTGC

SEQ ID NO: 1382 - protein, 8 aa, Artificial Sequence
  Representative cyclic modulating agent based on cadherin-7 cell adhesion recognition sequence
CFSVEPKC

SEQ ID NO: 1383 - protein, 9 aa, Artificial Sequence
  Representative cyclic modulating agent based on cadherin-7 cell adhesion recognition sequence
CFSVEPKTC

SEQ ID NO: 1384 - protein, 10 aa, Artificial Sequence
  Representative cyclic modulating agent based on cadherin-7 cell adhesion recognition sequence
CFSVEPKTGC

SEQ ID NO: 1385 - protein, 9 aa, Artificial Sequence
  Representative cyclic modulating agent based on cadherin-7 cell adhesion recognition sequence
CYFSVEPKC

SEQ ID NO: 1386 - protein, 10 aa, Artificial Sequence
  Representative cyclic modulating agent based on cadherin-7 cell adhesion recognition sequence
CYFSVEPKTC

SEQ ID NO: 1387 - protein, 11 aa, Artificial Sequence
  Representative cyclic modulating agent based on cadherin-7 cell adhesion recognition sequence
CYFSVEPKTGC

SEQ ID NO: 1388 - protein, 5 aa, Artificial Sequence
  Representative cyclic modulating agent based on cadherin-7 cell adhesion recognition sequence
CDANC

SEQ ID NO: 1389 - protein, 6 aa, Artificial Sequence
  Representative cyclic modulating agent based on cadherin-7 cell adhesion recognition sequence
CDANSC

SEQ ID NO: 1390 - protein, 7 aa, Artificial Sequence
  Representative cyclic modulating agent based on cadherin-7 cell adhesion recognition sequence
CDANSGC

SEQ ID NO: 1391 - protein, 6 aa, Artificial Sequence
  Representative cyclic modulating agent based on cadherin-7 cell adhesion recognition sequence
CIDANC

SEQ ID NO: 1392 - protein, 7 aa, Artificial Sequence
  Representative cyclic modulating agent based on cadherin-7 cell adhesion recognition sequence
CIDANSC

SEQ ID NO: 1393 - protein, 8 aa, Artificial Sequence
  Representative cyclic modulating agent based on cadherin-7 cell adhesion recognition sequence
CIDANSGC

SEQ ID NO: 1394 - protein, 7 aa, Artificial Sequence
  Representative cyclic modulating agent based on cadherin-7 cell adhesion recognition sequence
CNIDANC

SEQ ID NO: 1395 - protein, 8 aa, Artificial Sequence
  Representative cyclic modulating agent based on cadherin-7 cell adhesion recognition sequence
CNIDANSC

SEQ ID NO: 1396 - protein, 9 aa, Artificial Sequence
  Representative cyclic modulating agent based on cadherin-7 cell adhesion recognition sequence
CNIDANSGC

SEQ ID NO: 1397 - protein, 8 aa, Artificial Sequence
  Representative cyclic modulating agent based on cadherin-7 cell adhesion recognition sequence
CFNIDANC

SEQ ID NO: 1398 - protein, 9 aa, Artificial Sequence
  Representative cyclic modulating agent based on cadherin-7 cell adhesion recognition sequence
CFNIDANSC

SEQ ID NO: 1399 - protein, 10 aa, Artificial Sequence
  Representative cyclic modulating agent based on cadherin-7 cell adhesion recognition sequence
CFNIDANSGC

SEQ ID NO: 1400 - protein, 9 aa, Artificial Sequence
  Representative cyclic modulating agent based on cadherin-7 cell adhesion recognition sequence
CYFNIDANC

SEQ ID NO: 1401 - protein, 10 aa, Artificial Sequence
  Representative cyclic modulating agent based on cadherin-7 cell adhesion recognition sequence
CYFNIDANSC

SEQ ID NO: 1402 - protein, 11 aa, Artificial Sequence
  Representative cyclic modulating agent based on cadherin-7 cell adhesion recognition sequence
CYFNIDANSGC

SEQ ID NO: 1403 - protein, 5 aa, Artificial Sequence
  Representative cyclic modulating agent based on cadherin-7 cell adhesion recognition sequence
EEPKK

SEQ ID NO: 1404 - protein, 6 aa, Artificial Sequence
  Representative cyclic modulating agent based on cadherin-7 cell adhesion recognition sequence
EEPKTK

SEQ ID NO: 1405 - protein, 7 aa, Artificial Sequence
  Representative cyclic modulating agent based on cadherin-7 cell adhesion recognition sequence
EEPKTGK

SEQ ID NO: 1406 - protein, 6 aa, Artificial Sequence
  Representative cyclic modulating agent based on cadherin-7 cell adhesion recognition sequence
EVEPKK

SEQ ID NO: 1407 - protein, 7 aa, Artificial Sequence
  Representative cyclic modulating agent based on cadherin-7 cell adhesion recognition sequence
EVEPKTK

SEQ ID NO: 1408 - protein, 8 aa, Artificial Sequence
  Representative cyclic modulating agent based on cadherin-7 cell adhesion recognition sequence
EVEPKTGK

SEQ ID NO: 1409 - protein, 7 aa, Artificial Sequence
  Representative cyclic modulating agent based on cadherin-7 cell adhesion recognition sequence
ESVEPKK

SEQ ID NO: 1410 - protein, 8 aa, Artificial Sequence
  Representative cyclic modulating agent based on cadherin-7 cell adhesion recognition sequence
ESVEPKTK

SEQ ID NO: 1411 - protein, 9 aa, Artificial Sequence
  Representative cyclic modulating agent based on cadherin-7 cell adhesion recognition sequence
ESVEPKTGK

SEQ ID NO: 1412 - protein, 8 aa, Artificial Sequence
  Representative cyclic modulating agent based on cadherin-7 cell adhesion recognition sequence
EFSVEPKK

SEQ ID NO: 1413 - protein, 9 aa, Artificial Sequence
  Representative cyclic modulating agent based on cadherin-7 cell adhesion recognition sequence
EFSVEPKTK

SEQ ID NO: 1414 - protein, 10 aa, Artificial Sequence
  Representative cyclic modulating agent based on cadherin-7 cell adhesion recognition sequence
EFSVEPKTGK

SEQ ID NO: 1415 - protein, 9 aa, Artificial Sequence
  Representative cyclic modulating agent based on cadherin-7 cell adhesion recognition sequence
EYFSVEPKK

SEQ ID NO: 1416 - protein, 10 aa, Artificial Sequence
  Representative cyclic modulating agent based on cadherin-7 cell adhesion recognition sequence
EYFSVEPKTK

SEQ ID NO: 1417 - protein, 11 aa, Artificial Sequence
  Representative cyclic modulating agent based on cadherin-7 cell adhesion recognition sequence
EYFSVEPKTGK

SEQ ID NO: 1418 - protein, 5 aa, Artificial Sequence
  Representative cyclic modulating agent based on cadherin-7 cell adhesion recognition sequence
EDANK

SEQ ID NO: 1419 - protein, 6 aa, Artificial Sequence
  Representative cyclic modulating agent based on cadherin-7 cell adhesion recognition sequence
EDANSK

SEQ ID NO: 1420 - protein, 7 aa, Artificial Sequence
  Representative cyclic modulating agent based on cadherin-7 cell adhesion recognition sequence
EDANSGK

SEQ ID NO: 1421 - protein, 6 aa, Artificial Sequence
  Representative cyclic modulating agent based on cadherin-7 cell adhesion recognition sequence
EIDANK

SEQ ID NO: 1422 - protein, 7 aa, Artificial Sequence
  Representative cyclic modulating agent based on cadherin-7 cell adhesion recognition sequence
EIDANSK

SEQ ID NO: 1423 - protein, 8 aa, Artificial Sequence
  Representative cyclic modulating agent based on cadherin-7 cell adhesion recognition sequence
EIDANSGK

SEQ ID NO: 1424 - protein, 7 aa, Artificial Sequence
  Representative cyclic modulating agent based on cadherin-7 cell adhesion recognition sequence
ENIDANK

SEQ ID NO: 1425 - protein, 8 aa, Artificial Sequence
  Representative cyclic modulating agent based on cadherin-7 cell adhesion recognition sequence
ENIDANSK

SEQ ID NO: 1426 - protein, 9 aa, Artificial Sequence
  Representative cyclic modulating agent based on cadherin-7 cell adhesion recognition sequence
ENIDANSGK

SEQ ID NO: 1427 - protein, 8 aa, Artificial Sequence
  Representative cyclic modulating agent based on cadherin-7 cell adhesion recognition sequence
EFNIDANK

SEQ ID NO: 1428 - protein, 9 aa, Artificial Sequence
  Representative cyclic modulating agent based on cadherin-7 cell adhesion recognition sequence
EFNIDANSK

SEQ ID NO: 1429 - protein, 10 aa, Artificial Sequence
  Representative cyclic modulating agent based on cadherin-7 cell adhesion recognition sequence
EFNIDANSGK

SEQ ID NO: 1430 - protein, 9 aa, Artificial Sequence
  Representative cyclic modulating agent based on cadherin-7 cell adhesion recognition sequence
EYFNIDANK

SEQ ID NO: 1431 - protein, 10 aa, Artificial Sequence
  Representative cyclic modulating agent based on cadherin-7 cell adhesion recognition sequence
EYFNIDANSK

SEQ ID NO: 1432 - protein, 11 aa, Artificial Sequence
  Representative cyclic modulating agent based on cadherin-7 cell adhesion recognition sequence
EYFNIDANSGK

SEQ ID NO: 1433 - protein, 5 aa, Artificial Sequence
  Representative cyclic modulating agent based on cadherin-7 cell adhesion recognition sequence
KDAND

SEQ ID NO: 1434 - protein, 6 aa, Artificial Sequence
  Representative cyclic modulating agent based on cadherin-7 cell adhesion recognition sequence
KIDAND

SEQ ID NO: 1435 - protein, 6 aa, Artificial Sequence
  Representative cyclic modulating agent based on cadherin-7 cell adhesion recognition sequence
KDANSD

SEQ ID NO: 1436 - protein, 7 aa, Artificial Sequence
  Representative cyclic modulating agent based on cadherin-7 cell adhesion recognition sequence
KNIDAND

SEQ ID NO: 1437 - protein, 7 aa, Artificial Sequence
  Representative cyclic modulating agent based on cadherin-7 cell adhesion recognition sequence
KIDANSD

SEQ ID NO: 1438 - protein, 8 aa, Artificial Sequence
  Representative cyclic modulating agent based on cadherin-7 cell adhesion recognition sequence
KNIDANSD

SEQ ID NO: 1439 - protein, 7 aa, Artificial Sequence
  Representative cyclic modulating agent based on cadherin-7 cell adhesion recognition sequence
KDANSGD

SEQ ID NO: 1440 - protein, 8 aa, Artificial Sequence
  Representative cyclic modulating agent based on cadherin-7 cell adhesion recognition sequence
KIDANSGD

SEQ ID NO: 1441 - protein, 9 aa, Artificial Sequence
  Representative cyclic modulating agent based on cadherin-7 cell adhesion recognition sequence
KNIDANSGD

SEQ ID NO: 1442 - protein, 8 aa, Artificial Sequence
  Representative cyclic modulating agent based on cadherin-7 cell adhesion recognition sequence
KFNIDAND

SEQ ID NO: 1443 - protein, 9 aa, Artificial Sequence
  Representative cyclic modulating agent based on cadherin-7 cell adhesion recognition sequence
KFNIDANSD

SEQ ID NO: 1444 - protein, 10 aa, Artificial Sequence
  Representative cyclic modulating agent based on cadherin-7 cell adhesion recognition sequence
KFNIDANSGD

SEQ ID NO: 1445 - protein, 9 aa, Artificial Sequence
  Representative cyclic modulating agent based on cadherin-7 cell adhesion recognition sequence
KYFNIDAND

SEQ ID NO: 1446 - protein, 10 aa, Artificial Sequence
  Representative cyclic modulating agent based on cadherin-7 cell adhesion recognition sequence
KYFNIDANSD

SEQ ID NO: 1447 - protein, 11 aa, Artificial Sequence
  Representative cyclic modulating agent based on cadherin-7 cell adhesion recognition sequence
KYFNIDANSGD

SEQ ID NO: 1448 - protein, 5 aa, Artificial Sequence
  Representative cyclic modulating agent based on cadherin-7 cell adhesion recognition sequence
KEPKD

SEQ ID NO: 1449 - protein, 6 aa, Artificial Sequence
  Representative cyclic modulating agent based on cadherin-7 cell adhesion recognition sequence
KEPKTD

SEQ ID NO: 1450 - protein, 7 aa, Artificial Sequence
  Representative cyclic modulating agent based on cadherin-7 cell adhesion recognition sequence
KEPKTGD

SEQ ID NO: 1451 - protein, 6 aa, Artificial Sequence
  Representative cyclic modulating agent based on cadherin-7 cell adhesion recognition sequence
KVEPKD

SEQ ID NO: 1452 - protein, 7 aa, Artificial Sequence
  Representative cyclic modulating agent based on cadherin-7 cell adhesion recognition sequence
KVEPKTD

SEQ ID NO: 1453 - protein, 8 aa, Artificial Sequence
  Representative cyclic modulating agent based on cadherin-7 cell adhesion recognition sequence
KVEPKTGD

SEQ ID NO: 1454 - protein, 7 aa, Artificial Sequence
  Representative cyclic modulating agent based on cadherin-7 cell adhesion recognition sequence
KSVEPKD

SEQ ID NO: 1455 - protein, 8 aa, Artificial Sequence
  Representative cyclic modulating agent based on cadherin-7 cell adhesion recognition sequence
KSVEPKTD

SEQ ID NO: 1456 - protein, 9 aa, Artificial Sequence
  Representative cyclic modulating agent based on cadherin-7 cell adhesion recognition sequence
KSVEPKTGD

SEQ ID NO: 1457 - protein, 8 aa, Artificial Sequence
  Representative cyclic modulating agent based on cadherin-7 cell adhesion recognition sequence
KFSVEPKD

SEQ ID NO: 1458 - protein, 9 aa, Artificial Sequence
  Representative cyclic modulating agent based on cadherin-7 cell adhesion recognition sequence
KFSVEPKTD

SEQ ID NO: 1459 - protein, 10 aa, Artificial Sequence
  Representative cyclic modulating agent based on cadherin-7 cell adhesion recognition sequence
KFSVEPKTGD

SEQ ID NO: 1460 - protein, 9 aa, Artificial Sequence
  Representative cyclic modulating agent based on cadherin-7 cell adhesion recognition sequence
KYFSVEPKD

SEQ ID NO: 1461 - protein, 10 aa, Artificial Sequence
  Representative cyclic modulating agent based on cadherin-7 cell adhesion recognition sequence
KYFSVEPKTD

SEQ ID NO: 1462 - protein, 11 aa, Artificial Sequence
  Representative cyclic modulating agent based on cadherin-7 cell adhesion recognition sequence
KYFSVEPKTGD

SEQ ID NO: 1463 - protein, 5 aa, Artificial Sequence
  Representative cyclic modulating agent based on cadherin-7 cell adhesion recognition sequence
KDAND

SEQ ID NO: 1464 - protein, 6 aa, Artificial Sequence
  Representative cyclic modulating agent based on cadherin-7 cell adhesion recognition sequence
KDANSD

SEQ ID NO: 1465 - protein, 7 aa, Artificial Sequence
  Representative cyclic modulating agent based on cadherin-7 cell adhesion recognition sequence
KDANSGD

SEQ ID NO: 1466 - protein, 6 aa, Artificial Sequence
  Representative cyclic modulating agent based on cadherin-7 cell adhesion recognition sequence
KIDAND

SEQ ID NO: 1467 - protein, 7 aa, Artificial Sequence
  Representative cyclic modulating agent based on cadherin-7 cell adhesion recognition sequence
KIDANSD

SEQ ID NO: 1468 - protein, 8 aa, Artificial Sequence
  Representative cyclic modulating agent based on cadherin-7 cell adhesion recognition sequence
KIDANSGD

SEQ ID NO: 1469 - protein, 7 aa, Artificial Sequence
  Representative cyclic modulating agent based on cadherin-7 cell adhesion recognition sequence
KNIDAND

SEQ ID NO: 1470 - protein, 8 aa, Artificial Sequence
  Representative cyclic modulating agent based on cadherin-7 cell adhesion recognition sequence
KNIDANSD

SEQ ID NO: 1471 - protein, 9 aa, Artificial Sequence
  Representative cyclic modulating agent based on cadherin-7 cell adhesion recognition sequence
KNIDANSGD

SEQ ID NO: 1472 - protein, 8 aa, Artificial Sequence
  Representative cyclic modulating agent based on cadherin-7 cell adhesion recognition sequence
KFNIDAND

SEQ ID NO: 1473 - protein, 9 aa, Artificial Sequence
  Representative cyclic modulating agent based on cadherin-7 cell adhesion recognition sequence
KFNIDANSD

SEQ ID NO: 1474 - protein, 10 aa, Artificial Sequence
  Representative cyclic modulating agent based on cadherin-7 cell adhesion recognition sequence
KFNIDANSGD

SEQ ID NO: 1475 - protein, 9 aa, Artificial Sequence
  Representative cyclic modulating agent based on cadherin-7 cell adhesion recognition sequence
KYFNIDAND

SEQ ID NO: 1476 - protein, 10 aa, Artificial Sequence
  Representative cyclic modulating agent based on cadherin-7 cell adhesion recognition sequence
KYFNIDANSD

SEQ ID NO: 1477 - protein, 11 aa, Artificial Sequence
  Representative cyclic modulating agent based on cadherin-7 cell adhesion recognition sequence
KYFNIDANSGD

SEQ ID NO: 1478 - protein, 5 aa, Artificial Sequence
  Representative cyclic modulating agent based on cadherin-7 cell adhesion recognition sequence
DEPKK

SEQ ID NO: 1479 - protein, 6 aa, Artificial Sequence
  Representative cyclic modulating agent based on cadherin-7 cell adhesion recognition sequence
DEPKTK

SEQ ID NO: 1480 - protein, 7 aa, Artificial Sequence
  Representative cyclic modulating agent based on cadherin-7 cell adhesion recognition sequence
DEPKTGK

SEQ ID NO: 1481 - protein, 6 aa, Artificial Sequence
  Representative cyclic modulating agent based on cadherin-7 cell adhesion recognition sequence
DVEPKK

SEQ ID NO: 1482 - protein, 7 aa, Artificial Sequence
  Representative cyclic modulating agent based on cadherin-7 cell adhesion recognition sequence
DVEPKTK

SEQ ID NO: 1483 - protein, 8 aa, Artificial Sequence
  Representative cyclic modulating agent based on cadherin-7 cell adhesion recognition sequence
DVEPKTGK

SEQ ID NO: 1484 - protein, 7 aa, Artificial Sequence
  Representative cyclic modulating agent based on cadherin-7 cell adhesion recognition sequence
DSVEPKK

SEQ ID NO: 1485 - protein, 8 aa, Artificial Sequence
  Representative cyclic modulating agent based on cadherin-7 cell adhesion recognition sequence
DSVEPKTK

SEQ ID NO: 1486 - protein, 9 aa, Artificial Sequence
  Representative cyclic modulating agent based on cadherin-7 cell adhesion recognition sequence
DSVEPKTGK

SEQ ID NO: 1487 - protein, 8 aa, Artificial Sequence
  Representative cyclic modulating agent based on cadherin-7 cell adhesion recognition sequence
DFSVEPKK

SEQ ID NO: 1488 - protein, 9 aa, Artificial Sequence
  Representative cyclic modulating agent based on cadherin-7 cell adhesion recognition sequence
DFSVEPKTK

SEQ ID NO: 1489 - protein, 10 aa, Artificial Sequence
  Representative cyclic modulating agent based on cadherin-7 cell adhesion recognition sequence
DFSVEPKTGK

SEQ ID NO: 1490 - protein, 9 aa, Artificial Sequence
  Representative cyclic modulating agent based on cadherin-7 cell adhesion recognition sequence
DYFSVEPKK

SEQ ID NO: 1491 - protein, 10 aa, Artificial Sequence
  Representative cyclic modulating agent based on cadherin-7 cell adhesion recognition sequence
DYFSVEPKTK

SEQ ID NO: 1492 - protein, 11 aa, Artificial Sequence
  Representative cyclic modulating agent based on cadherin-7 cell adhesion recognition sequence
DYFSVEPKTGK

SEQ ID NO: 1493 - protein, 5 aa, Artificial Sequence
  Representative cyclic modulating agent based on cadherin-7 cell adhesion recognition sequence
DDANK

SEQ ID NO: 1494 - protein, 6 aa, Artificial Sequence
  Representative cyclic modulating agent based on cadherin-7 cell adhesion recognition sequence
DDANSK

SEQ ID NO: 1495 - protein, 7 aa, Artificial Sequence
  Representative cyclic modulating agent based on cadherin-7 cell adhesion recognition sequence
DDANSGK

SEQ ID NO: 1496 - protein, 6 aa, Artificial Sequence
  Representative cyclic modulating agent based on cadherin-7 cell adhesion recognition sequence
DIDANK

SEQ ID NO: 1497 - protein, 7 aa, Artificial Sequence
  Representative cyclic modulating agent based on cadherin-7 cell adhesion recognition sequence
DIDANSK

SEQ ID NO: 1498 - protein, 8 aa, Artificial Sequence
  Representative cyclic modulating agent based on cadherin-7 cell adhesion recognition sequence
DIDANSGK

SEQ ID NO: 1499 - protein, 7 aa, Artificial Sequence
  Representative cyclic modulating agent based on cadherin-7 cell adhesion recognition sequence
DNIDANK

SEQ ID NO: 1500 - protein, 8 aa, Artificial Sequence
  Representative cyclic modulating agent based on cadherin-7 cell adhesion recognition sequence
DNIDANSK

SEQ ID NO: 1501 - protein, 9 aa, Artificial Sequence
  Representative cyclic modulating agent based on cadherin-7 cell adhesion recognition sequence
DNIDANSGK

SEQ ID NO: 1502 - protein, 8 aa, Artificial Sequence
  Representative cyclic modulating agent based on cadherin-7 cell adhesion recognition sequence
DFNIDANK

SEQ ID NO: 1503 - protein, 9 aa, Artificial Sequence
  Representative cyclic modulating agent based on cadherin-7 cell adhesion recognition sequence
DFNIDANSK

SEQ ID NO: 1504 - protein, 10 aa, Artificial Sequence
  Representative cyclic modulating agent based on cadherin-7 cell adhesion recognition sequence
DFNIDANSGK

SEQ ID NO: 1505 - protein, 9 aa, Artificial Sequence
  Representative cyclic modulating agent based on cadherin-7 cell adhesion recognition sequence
DYFNIDANK

SEQ ID NO: 1506 - protein, 10 aa, Artificial Sequence
  Representative cyclic modulating agent based on cadherin-7 cell adhesion recognition sequence
DYFNIDANSK

SEQ ID NO: 1507 - protein, 11 aa, Artificial Sequence
  Representative cyclic modulating agent based on cadherin-7 cell adhesion recognition sequence
DYFNIDANSGK

SEQ ID NO: 1508 - protein, 5 aa, Artificial Sequence
  Representative cyclic modulating agent based on cadherin-7 cell adhesion recognition sequence
KDENE

SEQ ID NO: 1509 - protein, 6 aa, Artificial Sequence
  Representative cyclic modulating agent based on cadherin-7 cell adhesion recognition sequence
KDENTE

SEQ ID NO: 1510 - protein, 7 aa, Artificial Sequence
  Representative cyclic modulating agent based on cadherin-7 cell adhesion recognition sequence
KDENTGE

SEQ ID NO: 1511 - protein, 6 aa, Artificial Sequence
  Representative cyclic modulating agent based on cadherin-7 cell adhesion recognition sequence
KIDENE

SEQ ID NO: 1512 - protein, 7 aa, Artificial Sequence
  Representative cyclic modulating agent based on cadherin-7 cell adhesion recognition sequence
KIDENTE

SEQ ID NO: 1513 - protein, 8 aa, Artificial Sequence
  Representative cyclic modulating agent based on cadherin-7 cell adhesion recognition sequence
KIDENTGE

SEQ ID NO: 1514 - protein, 7 aa, Artificial Sequence
  Representative cyclic modulating agent based on cadherin-7 cell adhesion recognition sequence
KIIDENE

SEQ ID NO: 1515 - protein, 8 aa, Artificial Sequence
  Representative cyclic modulating agent based on cadherin-7 cell adhesion recognition sequence
KIIDENTE

SEQ ID NO: 1516 - protein, 9 aa, Artificial Sequence
  Representative cyclic modulating agent based on cadherin-7 cell adhesion recognition sequence
KIIDENTGE

SEQ ID NO: 1517 - protein, 8 aa, Artificial Sequence
  Representative cyclic modulating agent based on cadherin-7 cell adhesion recognition sequence
KFIIDENE

SEQ ID NO: 1518 - protein, 9 aa, Artificial Sequence
  Representative cyclic modulating agent based on cadherin-7 cell adhesion recognition sequence
KFIIDENTE

SEQ ID NO: 1519 - protein, 10 aa, Artificial Sequence
  Representative cyclic modulating agent based on cadherin-7 cell adhesion recognition sequence
KFIIDENTGE

SEQ ID NO: 1520 - protein, 9 aa, Artificial Sequence
  Representative cyclic modulating agent based on cadherin-7 cell adhesion recognition sequence
KIFIIDENE

SEQ ID NO: 1521 - protein, 10 aa, Artificial Sequence
  Representative cyclic modulating agent based on cadherin-7 cell adhesion recognition sequence
KIFIIDENTE

SEQ ID NO: 1522 - protein, 11 aa, Artificial Sequence
  Representative cyclic modulating agent based on cadherin-7 cell adhesion recognition sequence
KIFIIDENTGE

SEQ ID NO: 1523 - protein, 5 aa, Artificial Sequence
  Representative cyclic modulating agent based on cadherin-7 cell adhesion recognition sequence
KEPKE

SEQ ID NO: 1524 - protein, 6 aa, Artificial Sequence
  Representative cyclic modulating agent based on cadherin-7 cell adhesion recognition sequence
KEPKTE

SEQ ID NO: 1525 - protein, 7 aa, Artificial Sequence
  Representative cyclic modulating agent based on cadherin-7 cell adhesion recognition sequence
KEPKTGE

SEQ ID NO: 1526 - protein, 6 aa, Artificial Sequence
  Representative cyclic modulating agent based on cadherin-7 cell adhesion recognition sequence
KVEPKE

SEQ ID NO: 1527 - protein, 7 aa, Artificial Sequence
  Representative cyclic modulating agent based on cadherin-7 cell adhesion recognition sequence
KVEPKTE

SEQ ID NO: 1528 - protein, 8 aa, Artificial Sequence
  Representative cyclic modulating agent based on cadherin-7 cell adhesion recognition sequence
KVEPKTGE

SEQ ID NO: 1529 - protein, 7 aa, Artificial Sequence
  Representative cyclic modulating agent based on cadherin-7 cell adhesion recognition sequence
KSVEPKE

SEQ ID NO: 1530 - protein, 8 aa, Artificial Sequence
  Representative cyclic modulating agent based on cadherin-7 cell adhesion recognition sequence
KSVEPKTE

SEQ ID NO: 1531 - protein, 9 aa, Artificial Sequence
  Representative cyclic modulating agent based on cadherin-7 cell adhesion recognition sequence
KSVEPKTGE

SEQ ID NO: 1532 - protein, 8 aa, Artificial Sequence
  Representative cyclic modulating agent based on cadherin-7 cell adhesion recognition sequence
KFSVEPKE

SEQ ID NO: 1533 - protein, 9 aa, Artificial Sequence
  Representative cyclic modulating agent based on cadherin-7 cell adhesion recognition sequence
KFSVEPKTE

SEQ ID NO: 1534 - protein, 10 aa, Artificial Sequence
  Representative cyclic modulating agent based on cadherin-7 cell adhesion recognition sequence
KFSVEPKTGE

SEQ ID NO: 1535 - protein, 9 aa, Artificial Sequence
  Representative cyclic modulating agent based on cadherin-7 cell adhesion recognition sequence
KYFSVEPKE

SEQ ID NO: 1536 - protein, 10 aa, Artificial Sequence
  Representative cyclic modulating agent based on cadherin-7 cell adhesion recognition sequence
KYFSVEPKTE

SEQ ID NO: 1537 - protein, 11 aa, Artificial Sequence
  Representative cyclic modulating agent based on cadherin-7 cell adhesion recognition sequence
KYFSVEPKTGE

SEQ ID NO: 1538 - protein, 5 aa, Artificial Sequence
  Representative cyclic modulating agent based on cadherin-7 cell adhesion recognition sequence
KDANE

SEQ ID NO: 1539 - protein, 6 aa, Artificial Sequence
  Representative cyclic modulating agent based on cadherin-7 cell adhesion recognition sequence
KDANSE

SEQ ID NO: 1540 - protein, 7 aa, Artificial Sequence
  Representative cyclic modulating agent based on cadherin-7 cell adhesion recognition sequence
KDANSGE

SEQ ID NO: 1541 - protein, 6 aa, Artificial Sequence
  Representative cyclic modulating agent based on cadherin-7 cell adhesion recognition sequence
KIDANE

SEQ ID NO: 1542 - protein, 7 aa, Artificial Sequence
  Representative cyclic modulating agent based on cadherin-7 cell adhesion recognition sequence
KIDANSE

SEQ ID NO: 1543 - protein, 8 aa, Artificial Sequence
  Representative cyclic modulating agent based on cadherin-7 cell adhesion recognition sequence
KIDANSGE

SEQ ID NO: 1544 - protein, 7 aa, Artificial Sequence
  Representative cyclic modulating agent based on cadherin-7 cell adhesion recognition sequence
KNIDANE

SEQ ID NO: 1545 - protein, 8 aa, Artificial Sequence
  Representative cyclic modulating agent based on cadherin-7 cell adhesion recognition sequence
KNIDANSE

SEQ ID NO: 1546 - protein, 9 aa, Artificial Sequence
  Representative cyclic modulating agent based on cadherin-7 cell adhesion recognition sequence
KNIDANSGE

SEQ ID NO: 1547 - protein, 8 aa, Artificial Sequence
  Representative cyclic modulating agent based on cadherin-7 cell adhesion recognition sequence
KFNIDANE

SEQ ID NO: 1548 - protein, 9 aa, Artificial Sequence
  Representative cyclic modulating agent based on cadherin-7 cell adhesion recognition sequence
KFNIDANSE

SEQ ID NO: 1549 - protein, 10 aa, Artificial Sequence
  Representative cyclic modulating agent based on cadherin-7 cell adhesion recognition sequence
KFNIDANSGE

SEQ ID NO: 1550 - protein, 9 aa, Artificial Sequence
  Representative cyclic modulating agent based on cadherin-7 cell adhesion recognition sequence
KYFNIDANE

SEQ ID NO: 1551 - protein, 10 aa, Artificial Sequence
  Representative cyclic modulating agent based on cadherin-7 cell adhesion recognition sequence
KYFNIDANSE

SEQ ID NO: 1552 - protein, 11 aa, Artificial Sequence
  Representative cyclic modulating agent based on cadherin-7 cell adhesion recognition sequence
KYFNIDANSGE

SEQ ID NO: 1553 - protein, 5 aa, Artificial Sequence
  Representative cyclic modulating agent based on cadherin-7 cell adhesion recognition sequence
DENTG

SEQ ID NO: 1554 - protein, 5 aa, Artificial Sequence
  Representative cyclic modulating agent based on cadherin-7 cell adhesion recognition sequence
IDENT

SEQ ID NO: 1555 - protein, 6 aa, Artificial Sequence
  Representative cyclic modulating agent based on cadherin-7 cell adhesion recognition sequence
IDENTG

SEQ ID NO: 1556 - protein, 5 aa, Artificial Sequence
  Representative cyclic modulating agent based on cadherin-7 cell adhesion recognition sequence
IIDEN

SEQ ID NO: 1557 - protein, 6 aa, Artificial Sequence
  Representative cyclic modulating agent based on cadherin-7 cell adhesion recognition sequence
IIDENT

SEQ ID NO: 1558 - protein, 7 aa, Artificial Sequence
  Representative cyclic modulating agent based on cadherin-7 cell adhesion recognition sequence
IIDENTG

SEQ ID NO: 1559 - protein, 6 aa, Artificial Sequence
  Representative cyclic modulating agent based on cadherin-7 cell adhesion recognition sequence
FIIDEN

SEQ ID NO: 1560 - protein, 7 aa, Artificial Sequence
  Representative cyclic modulating agent based on cadherin-7 cell adhesion recognition sequence
FIIDENT

SEQ ID NO: 1561 - protein, 8 aa, Artificial Sequence
  Representative cyclic modulating agent based on cadherin-7 cell adhesion recognition sequence
FIIDENTG

SEQ ID NO: 1562 - protein, 7 aa, Artificial Sequence
  Representative cyclic modulating agent based on cadherin-7 cell adhesion recognition sequence
IFIIDEN

SEQ ID NO: 1563 - protein, 8 aa, Artificial Sequence
  Representative cyclic modulating agent based on cadherin-7 cell adhesion recognition sequence
IFIIDENT

SEQ ID NO: 1564 - protein, 9 aa, Artificial Sequence
  Representative cyclic modulating agent based on cadherin-7 cell adhesion recognition sequence
IFIIDENTG

SEQ ID NO: 1565 - protein, 5 aa, Artificial Sequence
  Representative cyclic modulating agent based on cadherin-7 cell adhesion recognition sequence
EPKTG

SEQ ID NO: 1566 - protein, 5 aa, Artificial Sequence
  Representative cyclic modulating agent based on cadherin-7 cell adhesion recognition sequence
VEPKT

SEQ ID NO: 1567 - protein, 6 aa, Artificial Sequence
  Representative cyclic modulating agent based on cadherin-7 cell adhesion recognition sequence
VEPKTG

SEQ ID NO: 1568 - protein, 5 aa, Artificial Sequence
  Representative cyclic modulating agent based on cadherin-7 cell adhesion recognition sequence
SVEPK

SEQ ID NO: 1569 - protein, 6 aa, Artificial Sequence
  Representative cyclic modulating agent based on cadherin-7 cell adhesion recognition sequence
SVEPKT

SEQ ID NO: 1570 - protein, 7 aa, Artificial Sequence
  Representative cyclic modulating agent based on cadherin-7 cell adhesion recognition sequence
SVEPKTG

SEQ ID NO: 1571 - protein, 6 aa, Artificial Sequence
  Representative cyclic modulating agent based on cadherin-7 cell adhesion recognition sequence
FSVEPK

SEQ ID NO: 1572 - protein, 7 aa, Artificial Sequence
  Representative cyclic modulating agent based on cadherin-7 cell adhesion recognition sequence
FSVEPKT

SEQ ID NO: 1573 - protein, 8 aa, Artificial Sequence
  Representative cyclic modulating agent based on cadherin-7 cell adhesion recognition sequence
FSVEPKTG

SEQ ID NO: 1574 - protein, 7 aa, Artificial Sequence
  Representative cyclic modulating agent based on cadherin-7 cell adhesion recognition sequence
YFSVEPK

SEQ ID NO: 1575 - protein, 8 aa, Artificial Sequence
  Representative cyclic modulating agent based on cadherin-7 cell adhesion recognition sequence
YFSVEPKT

SEQ ID NO: 1576 - protein, 9 aa, Artificial Sequence
  Representative cyclic modulating agent based on cadherin-7 cell adhesion recognition sequence
YFSVEPKTG

SEQ ID NO: 1577 - protein, 5 aa, Artificial Sequence
  Representative cyclic modulating agent based on cadherin-7 cell adhesion recognition sequence
DANSG

SEQ ID NO: 1578 - protein, 5 aa, Artificial Sequence
  Representative cyclic modulating agent based on cadherin-7 cell adhesion recognition sequence
IDANS

SEQ ID NO: 1579 - protein, 6 aa, Artificial Sequence
  Representative cyclic modulating agent based on cadherin-7 cell adhesion recognition sequence
IDANSG

SEQ ID NO: 1580 - protein, 5 aa, Artificial Sequence
  Representative cyclic modulating agent based on cadherin-7 cell adhesion recognition sequence
NIDAN

SEQ ID NO: 1581 - protein, 6 aa, Artificial Sequence
  Representative cyclic modulating agent based on cadherin-7 cell adhesion recognition sequence
NIDANS

SEQ ID NO: 1582 - protein, 7 aa, Artificial Sequence
  Representative cyclic modulating agent based on cadherin-7 cell adhesion recognition sequence
NIDANSG

SEQ ID NO: 1583 - protein, 6 aa, Artificial Sequence
  Representative cyclic modulating agent based on cadherin-7 cell adhesion recognition sequence
FNIDAN

SEQ ID NO: 1584 - protein, 7 aa, Artificial Sequence
  Representative cyclic modulating agent based on cadherin-7 cell adhesion recognition sequence
FNIDANS

SEQ ID NO: 1585 - protein, 8 aa, Artificial Sequence
  Representative cyclic modulating agent based on cadherin-7 cell adhesion recognition sequence
FNIDANSG

SEQ ID NO: 1586 - protein, 7 aa, Artificial Sequence
  Representative cyclic modulating agent based on cadherin-7 cell adhesion recognition sequence
YFNIDAN

SEQ ID NO: 1587 - protein, 8 aa, Artificial Sequence
  Representative cyclic modulating agent based on cadherin-7 cell adhesion recognition sequence
YFNIDANS

SEQ ID NO: 1588 - protein, 9 aa, Artificial Sequence
  Representative cyclic modulating agent based on cadherin-7 cell adhesion recognition sequence
YFNIDANSG

SEQ ID NO: 1589 - protein, 5 aa, Artificial Sequence
  Representative cyclic modulating agent based on cadherin-8 cell adhesion recognition sequence
CNDVC

SEQ ID NO: 1590 - protein, 6 aa, Artificial Sequence
  Representative cyclic modulating agent based on cadherin-8 cell adhesion recognition sequence
CINDVC

SEQ ID NO: 1591 - protein, 6 aa, Artificial Sequence
  Representative cyclic modulating agent based on cadherin-8 cell adhesion recognition sequence
CNDVTC

SEQ ID NO: 1592 - protein, 7 aa, Artificial Sequence
  Representative cyclic modulating agent based on cadherin-8 cell adhesion recognition sequence
CQINDVC

SEQ ID NO: 1593 - protein, 7 aa, Artificial Sequence
  Representative cyclic modulating agent based on cadherin-8 cell adhesion recognition sequence
CINDVTC

SEQ ID NO: 1594 - protein, 8 aa, Artificial Sequence
  Representative cyclic modulating agent based on cadherin-8 cell adhesion recognition sequence
CQINDVTC

SEQ ID NO: 1595 - protein, 7 aa, Artificial Sequence
  Representative cyclic modulating agent based on cadherin-8 cell adhesion recognition sequence
CNDVTGC

SEQ ID NO: 1596 - protein, 8 aa, Artificial Sequence
  Representative cyclic modulating agent based on cadherin-8 cell adhesion recognition sequence
CINDVTGC

SEQ ID NO: 1597 - protein, 9 aa, Artificial Sequence
  Representative cyclic modulating agent based on cadherin-8 cell adhesion recognition sequence
CQINDVTGC

SEQ ID NO: 1598 - protein, 8 aa, Artificial Sequence
  Representative cyclic modulating agent based on cadherin-8 cell adhesion recognition sequence
CFQINDVC

SEQ ID NO: 1599 - protein, 9 aa, Artificial Sequence
  Representative cyclic modulating agent based on cadherin-8 cell adhesion recognition sequence
CFQINDVTC

SEQ ID NO: 1600 - protein, 10 aa, Artificial Sequence
  Representative cyclic modulating agent based on cadherin-8 cell adhesion recognition sequence
CFQINDVTGC

SEQ ID NO: 1601 - protein, 9 aa, Artificial Sequence
  Representative cyclic modulating agent based on cadherin-8 cell adhesion recognition sequence
CIFQINDVC

SEQ ID NO: 1602 - protein, 10 aa, Artificial Sequence
  Representative cyclic modulating agent based on cadherin-8 cell adhesion recognition sequence
CIFQINDVTC

SEQ ID NO: 1603 - protein, 11 aa, Artificial Sequence
  Representative cyclic modulating agent based on cadherin-8 cell adhesion recognition sequence
CIFQINDVTGC

SEQ ID NO: 1604 - protein, 5 aa, Artificial Sequence
  Representative cyclic modulating agent based on cadherin-8 cell adhesion recognition sequence
DNDVK

SEQ ID NO: 1605 - protein, 6 aa, Artificial Sequence
  Representative cyclic modulating agent based on cadherin-8 cell adhesion recognition sequence
DINDVK

SEQ ID NO: 1606 - protein, 7 aa, Artificial Sequence
  Representative cyclic modulating agent based on cadherin-8 cell adhesion recognition sequence
DQINDVK

SEQ ID NO: 1607 - protein, 8 aa, Artificial Sequence
  Representative cyclic modulating agent based on cadherin-8 cell adhesion recognition sequence
DFQINDVK

SEQ ID NO: 1608 - protein, 9 aa, Artificial Sequence
  Representative cyclic modulating agent based on cadherin-8 cell adhesion recognition sequence
DIFQINDVK

SEQ ID NO: 1609 - protein, 5 aa, Artificial Sequence
  Representative cyclic modulating agent based on cadherin-8 cell adhesion recognition sequence
ENDVK

SEQ ID NO: 1610 - protein, 6 aa, Artificial Sequence
  Representative cyclic modulating agent based on cadherin-8 cell adhesion recognition sequence
EINDVK

SEQ ID NO: 1611 - protein, 7 aa, Artificial Sequence
  Representative cyclic modulating agent based on cadherin-8 cell adhesion recognition sequence
EQINDVK

SEQ ID NO: 1612 - protein, 8 aa, Artificial Sequence
  Representative cyclic modulating agent based on cadherin-8 cell adhesion recognition sequence
EFQINDVK

SEQ ID NO: 1613 - protein, 9 aa, Artificial Sequence
  Representative cyclic modulating agent based on cadherin-8 cell adhesion recognition sequence
EIFQINDVK

SEQ ID NO: 1614 - protein, 5 aa, Artificial Sequence
  Representative cyclic modulating agent based on cadherin-8 cell adhesion recognition sequence
KNDVD

SEQ ID NO: 1615 - protein, 6 aa, Artificial Sequence
  Representative cyclic modulating agent based on cadherin-8 cell adhesion recognition sequence
KINDVD

SEQ ID NO: 1616 - protein, 6 aa, Artificial Sequence
  Representative cyclic modulating agent based on cadherin-8 cell adhesion recognition sequence
KNDVTD

SEQ ID NO: 1617 - protein, 7 aa, Artificial Sequence
  Representative cyclic modulating agent based on cadherin-8 cell adhesion recognition sequence
KQINDVD

SEQ ID NO: 1618 - protein, 7 aa, Artificial Sequence
  Representative cyclic modulating agent based on cadherin-8 cell adhesion recognition sequence
KINDVTD

SEQ ID NO: 1619 - protein, 8 aa, Artificial Sequence
  Representative cyclic modulating agent based on cadherin-8 cell adhesion recognition sequence
KQINDVTD

SEQ ID NO: 1620 - protein, 7 aa, Artificial Sequence
  Representative cyclic modulating agent based on cadherin-8 cell adhesion recognition sequence
KNDVTGD

SEQ ID NO: 1621 - protein, 8 aa, Artificial Sequence
  Representative cyclic modulating agent based on cadherin-8 cell adhesion recognition sequence
KINDVTGD

SEQ ID NO: 1622 - protein, 9 aa, Artificial Sequence
  Representative cyclic modulating agent based on cadherin-8 cell adhesion recognition sequence
KQINDVTGD

SEQ ID NO: 1623 - protein, 8 aa, Artificial Sequence
  Representative cyclic modulating agent based on cadherin-8 cell adhesion recognition sequence
KFQINDVD

SEQ ID NO: 1624 - protein, 9 aa, Artificial Sequence
  Representative cyclic modulating agent based on cadherin-8 cell adhesion recognition sequence
KFQINDVTD

SEQ ID NO: 1625 - protein, 10 aa, Artificial Sequence
  Representative cyclic modulating agent based on cadherin-8 cell adhesion recognition sequence
KFQINDVTGD

SEQ ID NO: 1626 - protein, 9 aa, Artificial Sequence
  Representative cyclic modulating agent based on cadherin-8 cell adhesion recognition sequence
KIFQINDVD

SEQ ID NO: 1627 - protein, 10 aa, Artificial Sequence
  Representative cyclic modulating agent based on cadherin-8 cell adhesion recognition sequence
KIFQINDVTD

SEQ ID NO: 1628 - protein, 11 aa, Artificial Sequence
  Representative cyclic modulating agent based on cadherin-8 cell adhesion recognition sequence
KIFQINDVTGD

SEQ ID NO: 1629 - protein, 5 aa, Artificial Sequence
  Representative cyclic modulating agent based on cadherin-8 cell adhesion recognition sequence
VNDVT

SEQ ID NO: 1630 - protein, 5 aa, Artificial Sequence
  Representative cyclic modulating agent based on cadherin-8 cell adhesion recognition sequence
INDVT

SEQ ID NO: 1631 - protein, 6 aa, Artificial Sequence
  Representative cyclic modulating agent based on cadherin-8 cell adhesion recognition sequence
QINDVT

SEQ ID NO: 1632 - protein, 5 aa, Artificial Sequence
  Representative cyclic modulating agent based on cadherin-8 cell adhesion recognition sequence
NDVTG

SEQ ID NO: 1633 - protein, 5 aa, Artificial Sequence
  Representative cyclic modulating agent based on cadherin-8 cell adhesion recognition sequence
INVTG

SEQ ID NO: 1634 - protein, 5 aa, Artificial Sequence
  Representative cyclic modulating agent based on cadherin-8 cell adhesion recognition sequence
KNDVE

SEQ ID NO: 1635 - protein, 6 aa, Artificial Sequence
  Representative cyclic modulating agent based on cadherin-8 cell adhesion recognition sequence
KINDVE

SEQ ID NO: 1636 - protein, 6 aa, Artificial Sequence
  Representative cyclic modulating agent based on cadherin-8 cell adhesion recognition sequence
KNDVTE

SEQ ID NO: 1637 - protein, 7 aa, Artificial Sequence
  Representative cyclic modulating agent based on cadherin-8 cell adhesion recognition sequence
KQINDVE

SEQ ID NO: 1638 - protein, 7 aa, Artificial Sequence
  Representative cyclic modulating agent based on cadherin-8 cell adhesion recognition sequence
KINDVTE

SEQ ID NO: 1639 - protein, 8 aa, Artificial Sequence
  Representative cyclic modulating agent based on cadherin-8 cell adhesion recognition sequence
KQINDVTE

SEQ ID NO: 1640 - protein, 7 aa, Artificial Sequence
  Representative cyclic modulating agent based on cadherin-8 cell adhesion recognition sequence
KNDVTGE

SEQ ID NO: 1641 - protein, 8 aa, Artificial Sequence
  Representative cyclic modulating agent based on cadherin-8 cell adhesion recognition sequence
KINDVTGE

SEQ ID NO: 1642 - protein, 9 aa, Artificial Sequence
  Representative cyclic modulating agent based on cadherin-8 cell adhesion recognition sequence
KQINDVTGE

SEQ ID NO: 1643 - protein, 8 aa, Artificial Sequence
  Representative cyclic modulating agent based on cadherin-8 cell adhesion recognition sequence
KFQINDVE

SEQ ID NO: 1644 - protein, 9 aa, Artificial Sequence
  Representative cyclic modulating agent based on cadherin-8 cell adhesion recognition sequence
KFQINDVTE

SEQ ID NO: 1645 - protein, 10 aa, Artificial Sequence
  Representative cyclic modulating agent based on cadherin-8 cell adhesion recognition sequence
KFQINDVTGE

SEQ ID NO: 1646 - protein, 9 aa, Artificial Sequence
  Representative cyclic modulating agent based on cadherin-8 cell adhesion recognition sequence
KIFQINDVE

SEQ ID NO: 1647 - protein, 10 aa, Artificial Sequence
  Representative cyclic modulating agent based on cadherin-8 cell adhesion recognition sequence
KIFQINDVTE

SEQ ID NO: 1648 - protein, 11 aa, Artificial Sequence
  Representative cyclic modulating agent based on cadherin-8 cell adhesion recognition sequence
KIFQINDVTGE

SEQ ID NO: 1649 - protein, 5 aa, Artificial Sequence
  Representative cyclic modulating agent based on cadherin-8 cell adhesion recognition sequence
CEEFC

SEQ ID NO: 1650 - protein, 6 aa, Artificial Sequence
  Representative cyclic modulating agent based on cadherin-8 cell adhesion recognition sequence
CEEFSC

SEQ ID NO: 1651 - protein, 7 aa, Artificial Sequence
  Representative cyclic modulating agent based on cadherin-8 cell adhesion recognition sequence
CEEFSGC

SEQ ID NO: 1652 - protein, 6 aa, Artificial Sequence
  Representative cyclic modulating agent based on cadherin-8 cell adhesion recognition sequence
CLEEFC

SEQ ID NO: 1653 - protein, 7 aa, Artificial Sequence
  Representative cyclic modulating agent based on cadherin-8 cell adhesion recognition sequence
CLEEFSC

SEQ ID NO: 1654 - protein, 8 aa, Artificial Sequence
  Representative cyclic modulating agent based on cadherin-8 cell adhesion recognition sequence
CLEEFSGC

SEQ ID NO: 1655 - protein, 7 aa, Artificial Sequence
  Representative cyclic modulating agent based on cadherin-8 cell adhesion recognition sequence
CVLEEFC

SEQ ID NO: 1656 - protein, 8 aa, Artificial Sequence
  Representative cyclic modulating agent based on cadherin-8 cell adhesion recognition sequence
CVLEEFSC

SEQ ID NO: 1657 - protein, 9 aa, Artificial Sequence
  Representative cyclic modulating agent based on cadherin-8 cell adhesion recognition sequence
CVLEEFSGC

SEQ ID NO: 1658 - protein, 8 aa, Artificial Sequence
  Representative cyclic modulating agent based on cadherin-8 cell adhesion recognition sequence
CFVLEEFC

SEQ ID NO: 1659 - protein, 9 aa, Artificial Sequence
  Representative cyclic modulating agent based on cadherin-8 cell adhesion recognition sequence
CFVLEEFSC

SEQ ID NO: 1660 - protein, 10 aa, Artificial Sequence
  Representative cyclic modulating agent based on cadherin-8 cell adhesion recognition sequence
CFVLEEFSGC

SEQ ID NO: 1661 - protein, 9 aa, Artificial Sequence
  Representative cyclic modulating agent based on cadherin-8 cell adhesion recognition sequence
CMFVLEEFC

SEQ ID NO: 1662 - protein, 10 aa, Artificial Sequence
  Representative cyclic modulating agent based on cadherin-8 cell adhesion recognition sequence
CMFVLEEFSC

SEQ ID NO: 1663 - protein, 11 aa, Artificial Sequence
  Representative cyclic modulating agent based on cadherin-8 cell adhesion recognition sequence
CMFVLEEFSGC

SEQ ID NO: 1664 - protein, 5 aa, Artificial Sequence
  Representative cyclic modulating agent based on cadherin-8 cell adhesion recognition sequence
EEEFK

SEQ ID NO: 1665 - protein, 6 aa, Artificial Sequence
  Representative cyclic modulating agent based on cadherin-8 cell adhesion recognition sequence
EEEFSK

SEQ ID NO: 1666 - protein, 7 aa, Artificial Sequence
  Representative cyclic modulating agent based on cadherin-8 cell adhesion recognition sequence
EEEFSGK

SEQ ID NO: 1667 - protein, 6 aa, Artificial Sequence
  Representative cyclic modulating agent based on cadherin-8 cell adhesion recognition sequence
ELEEFK

SEQ ID NO: 1668 - protein, 7 aa, Artificial Sequence
  Representative cyclic modulating agent based on cadherin-8 cell adhesion recognition sequence
ELEEFSK

SEQ ID NO: 1669 - protein, 8 aa, Artificial Sequence
  Representative cyclic modulating agent based on cadherin-8 cell adhesion recognition sequence
ELEEFSGK

SEQ ID NO: 1670 - protein, 7 aa, Artificial Sequence
  Representative cyclic modulating agent based on cadherin-8 cell adhesion recognition sequence
EVLEEFK

SEQ ID NO: 1671 - protein, 8 aa, Artificial Sequence
  Representative cyclic modulating agent based on cadherin-8 cell adhesion recognition sequence
EVLEEFSK

SEQ ID NO: 1672 - protein, 9 aa, Artificial Sequence
  Representative cyclic modulating agent based on cadherin-8 cell adhesion recognition sequence
EVLEEFSGK

SEQ ID NO: 1673 - protein, 8 aa, Artificial Sequence
  Representative cyclic modulating agent based on cadherin-8 cell adhesion recognition sequence
EFVLEEFK

SEQ ID NO: 1674 - protein, 9 aa, Artificial Sequence
  Representative cyclic modulating agent based on cadherin-8 cell adhesion recognition sequence
EFVLEEFSK

SEQ ID NO: 1675 - protein, 10 aa, Artificial Sequence
  Representative cyclic modulating agent based on cadherin-8 cell adhesion recognition sequence
EFVLEEFSGK

SEQ ID NO: 1676 - protein, 9 aa, Artificial Sequence
  Representative cyclic modulating agent based on cadherin-8 cell adhesion recognition sequence
EMFVLEEFK

SEQ ID NO: 1677 - protein, 10 aa, Artificial Sequence
  Representative cyclic modulating agent based on cadherin-8 cell adhesion recognition sequence
EMFVLEEFSK

SEQ ID NO: 1678 - protein, 11 aa, Artificial Sequence
  Representative cyclic modulating agent based on cadherin-8 cell adhesion recognition sequence
EMFVLEEFSGK

SEQ ID NO: 1679 - protein, 5 aa, Artificial Sequence
  Representative cyclic modulating agent based on cadherin-8 cell adhesion recognition sequence
KEEFD

SEQ ID NO: 1680 - protein, 6 aa, Artificial Sequence
  Representative cyclic modulating agent based on cadherin-8 cell adhesion recognition sequence
KEEFSD

SEQ ID NO: 1681 - protein, 7 aa, Artificial Sequence
  Representative cyclic modulating agent based on cadherin-8 cell adhesion recognition sequence
KEEFSGD

SEQ ID NO: 1682 - protein, 6 aa, Artificial Sequence
  Representative cyclic modulating agent based on cadherin-8 cell adhesion recognition sequence
KLEEFD

SEQ ID NO: 1683 - protein, 7 aa, Artificial Sequence
  Representative cyclic modulating agent based on cadherin-8 cell adhesion recognition sequence
KLEEFSD

SEQ ID NO: 1684 - protein, 8 aa, Artificial Sequence
  Representative cyclic modulating agent based on cadherin-8 cell adhesion recognition sequence
KLEEFSGD

SEQ ID NO: 1685 - protein, 7 aa, Artificial Sequence
  Representative cyclic modulating agent based on cadherin-8 cell adhesion recognition sequence
KVLEEFD

SEQ ID NO: 1686 - protein, 8 aa, Artificial Sequence
  Representative cyclic modulating agent based on cadherin-8 cell adhesion recognition sequence
KVLEEFSD

SEQ ID NO: 1687 - protein, 9 aa, Artificial Sequence
  Representative cyclic modulating agent based on cadherin-8 cell adhesion recognition sequence
KVLEEFSGD

SEQ ID NO: 1688 - protein, 8 aa, Artificial Sequence
  Representative cyclic modulating agent based on cadherin-8 cell adhesion recognition sequence
KFVLEEFD

SEQ ID NO: 1689 - protein, 9 aa, Artificial Sequence
  Representative cyclic modulating agent based on cadherin-8 cell adhesion recognition sequence
KFVLEEFSD

SEQ ID NO: 1690 - protein, 10 aa, Artificial Sequence
  Representative cyclic modulating agent based on cadherin-8 cell adhesion recognition sequence
KFVLEEFSGD

SEQ ID NO: 1691 - protein, 9 aa, Artificial Sequence
  Representative cyclic modulating agent based on cadherin-8 cell adhesion recognition sequence
KMFVLEEFD

SEQ ID NO: 1692 - protein, 10 aa, Artificial Sequence
  Representative cyclic modulating agent based on cadherin-8 cell adhesion recognition sequence
KMFVLEEFSD

SEQ ID NO: 1693 - protein, 11 aa, Artificial Sequence
  Representative cyclic modulating agent based on cadherin-8 cell adhesion recognition sequence
KMFVLEEFSGD

SEQ ID NO: 1694 - protein, 5 aa, Artificial Sequence
  Representative cyclic modulating agent based on cadherin-8 cell adhesion recognition sequence
DEEFK

SEQ ID NO: 1695 - protein, 6 aa, Artificial Sequence
  Representative cyclic modulating agent based on cadherin-8 cell adhesion recognition sequence
DEEFSK

SEQ ID NO: 1696 - protein, 7 aa, Artificial Sequence
  Representative cyclic modulating agent based on cadherin-8 cell adhesion recognition sequence
DEEFSGK

SEQ ID NO: 1697 - protein, 6 aa, Artificial Sequence
  Representative cyclic modulating agent based on cadherin-8 cell adhesion recognition sequence
DLEEFK

SEQ ID NO: 1698 - protein, 7 aa, Artificial Sequence
  Representative cyclic modulating agent based on cadherin-8 cell adhesion recognition sequence
DLEEFSK

SEQ ID NO: 1699 - protein, 8 aa, Artificial Sequence
  Representative cyclic modulating agent based on cadherin-8 cell adhesion recognition sequence
DLEEFSGK

SEQ ID NO: 1700 - protein, 7 aa, Artificial Sequence
  Representative cyclic modulating agent based on cadherin-8 cell adhesion recognition sequence
DVLEEFK

SEQ ID NO: 1701 - protein, 8 aa, Artificial Sequence
  Representative cyclic modulating agent based on cadherin-8 cell adhesion recognition sequence
DVLEEFSK

SEQ ID NO: 1702 - protein, 9 aa, Artificial Sequence
  Representative cyclic modulating agent based on cadherin-8 cell adhesion recognition sequence
DVLEEFSGK

SEQ ID NO: 1703 - protein, 8 aa, Artificial Sequence
  Representative cyclic modulating agent based on cadherin-8 cell adhesion recognition sequence
DFVLEEFK

SEQ ID NO: 1704 - protein, 9 aa, Artificial Sequence
  Representative cyclic modulating agent based on cadherin-8 cell adhesion recognition sequence
DFVLEEFSK

SEQ ID NO: 1705 - protein, 10 aa, Artificial Sequence
  Representative cyclic modulating agent based on cadherin-8 cell adhesion recognition sequence
DFVLEEFSGK

SEQ ID NO: 1706 - protein, 9 aa, Artificial Sequence
  Representative cyclic modulating agent based on cadherin-8 cell adhesion recognition sequence
DMFVLEEFK

SEQ ID NO: 1707 - protein, 10 aa, Artificial Sequence
  Representative cyclic modulating agent based on cadherin-8 cell adhesion recognition sequence
DMFVLEEFSK

SEQ ID NO: 1708 - protein, 11 aa, Artificial Sequence
  Representative cyclic modulating agent based on cadherin-8 cell adhesion recognition sequence
DMFVLEEFSGK

SEQ ID NO: 1709 - protein, 5 aa, Artificial Sequence
  Representative cyclic modulating agent based on cadherin-8 cell adhesion recognition sequence
KEEFE

SEQ ID NO: 1710 - protein, 6 aa, Artificial Sequence
  Representative cyclic modulating agent based on cadherin-8 cell adhesion recognition sequence
KEEFSE

SEQ ID NO: 1711 - protein, 7 aa, Artificial Sequence
  Representative cyclic modulating agent based on cadherin-8 cell adhesion recognition sequence
KEEFSGE

SEQ ID NO: 1712 - protein, 6 aa, Artificial Sequence
  Representative cyclic modulating agent based on cadherin-8 cell adhesion recognition sequence
KLEEFE

SEQ ID NO: 1713 - protein, 7 aa, Artificial Sequence
  Representative cyclic modulating agent based on cadherin-8 cell adhesion recognition sequence
KLEEFSE

SEQ ID NO: 1714 - protein, 8 aa, Artificial Sequence
  Representative cyclic modulating agent based on cadherin-8 cell adhesion recognition sequence
KLEEFSGE

SEQ ID NO: 1715 - protein, 7 aa, Artificial Sequence
  Representative cyclic modulating agent based on cadherin-8 cell adhesion recognition sequence
KVLEEFE

SEQ ID NO: 1716 - protein, 8 aa, Artificial Sequence
  Representative cyclic modulating agent based on cadherin-8 cell adhesion recognition sequence
KVLEEFSE

SEQ ID NO: 1717 - protein, 9 aa, Artificial Sequence
  Representative cyclic modulating agent based on cadherin-8 cell adhesion recognition sequence
KVLEEFSGE

SEQ ID NO: 1718 - protein, 8 aa, Artificial Sequence
  Representative cyclic modulating agent based on cadherin-8 cell adhesion recognition sequence
KFVLEEFE

SEQ ID NO: 1719 - protein, 9 aa, Artificial Sequence
  Representative cyclic modulating agent based on cadherin-8 cell adhesion recognition sequence
KFVLEEFSE

SEQ ID NO: 1720 - protein, 10 aa, Artificial Sequence
  Representative cyclic modulating agent based on cadherin-8 cell adhesion recognition sequence
KFVLEEFSGE

SEQ ID NO: 1721 - protein, 9 aa, Artificial Sequence
  Representative cyclic modulating agent based on cadherin-8 cell adhesion recognition sequence
KMFVLEEFE

SEQ ID NO: 1722 - protein, 10 aa, Artificial Sequence
  Representative cyclic modulating agent based on cadherin-8 cell adhesion recognition sequence
KMFVLEEFSE

SEQ ID NO: 1723 - protein, 11 aa, Artificial Sequence
  Representative cyclic modulating agent based on cadherin-8 cell adhesion recognition sequence
KMFVLEEFSGE

SEQ ID NO: 1724 - protein, 5 aa, Artificial Sequence
  Representative cyclic modulating agent based on cadherin-8 cell adhesion recognition sequence
EEFSG

SEQ ID NO: 1725 - protein, 5 aa, Artificial Sequence
  Representative cyclic modulating agent based on cadherin-8 cell adhesion recognition sequence
LEEFS

SEQ ID NO: 1726 - protein, 6 aa, Artificial Sequence
  Representative cyclic modulating agent based on cadherin-8 cell adhesion recognition sequence
LEEFSG

SEQ ID NO: 1727 - protein, 5 aa, Artificial Sequence
  Representative cyclic modulating agent based on cadherin-8 cell adhesion recognition sequence
VLEEF

SEQ ID NO: 1728 - protein, 6 aa, Artificial Sequence
  Representative cyclic modulating agent based on cadherin-8 cell adhesion recognition sequence
VLEEFS

SEQ ID NO: 1729 - protein, 7 aa, Artificial Sequence
  Representative cyclic modulating agent based on cadherin-8 cell adhesion recognition sequence
VLEEFSG

SEQ ID NO: 1730 - protein, 6 aa, Artificial Sequence
  Representative cyclic modulating agent based on cadherin-8 cell adhesion recognition sequence
FVLEEF

SEQ ID NO: 1731 - protein, 7 aa, Artificial Sequence
  Representative cyclic modulating agent based on cadherin-8 cell adhesion recognition sequence
FVLEEFS

SEQ ID NO: 1732 - protein, 8 aa, Artificial Sequence
  Representative cyclic modulating agent based on cadherin-8 cell adhesion recognition sequence
FVLEEFSG

SEQ ID NO: 1733 - protein, 7 aa, Artificial Sequence
  Representative cyclic modulating agent based on cadherin-8 cell adhesion recognition sequence
MFVLEEF

SEQ ID NO: 1734 - protein, 8 aa, Artificial Sequence
  Representative cyclic modulating agent based on cadherin-8 cell adhesion recognition sequence
MFVLEEFS

SEQ ID NO: 1735 - protein, 9 aa, Artificial Sequence
  Representative cyclic modulating agent based on cadherin-8 cell adhesion recognition sequence
MFVLEEFSG

SEQ ID NO: 1736 - protein, 5 aa, Artificial Sequence
  Representative cyclic modulating agent based on cadherin-12 cell adhesion recognition sequence
CDETC

SEQ ID NO: 1737 - protein, 6 aa, Artificial Sequence
  Representative cyclic modulating agent based on cadherin-12 cell adhesion recognition sequence
CIDETC

SEQ ID NO: 1738 - protein, 6 aa, Artificial Sequence
  Representative cyclic modulating agent based on cadherin-12 cell adhesion recognition sequence
CDETTC

SEQ ID NO: 1739 - protein, 7 aa, Artificial Sequence
  Representative cyclic modulating agent based on cadherin-12 cell adhesion recognition sequence
CTIDETC

SEQ ID NO: 1740 - protein, 7 aa, Artificial Sequence
  Representative cyclic modulating agent based on cadherin-12 cell adhesion recognition sequence
CIDETTC

SEQ ID NO: 1741 - protein, 8 aa, Artificial Sequence
  Representative cyclic modulating agent based on cadherin-12 cell adhesion recognition sequence
CTIDETTC

SEQ ID NO: 1742 - protein, 7 aa, Artificial Sequence
  Representative cyclic modulating agent based on cadherin-12 cell adhesion recognition sequence
CDETTGC

SEQ ID NO: 1743 - protein, 8 aa, Artificial Sequence
  Representative cyclic modulating agent based on cadherin-12 cell adhesion recognition sequence
CIDETTGC

SEQ ID NO: 1744 - protein, 9 aa, Artificial Sequence
  Representative cyclic modulating agent based on cadherin-12 cell adhesion recognition sequence
CTIDETTGC

SEQ ID NO: 1745 - protein, 8 aa, Artificial Sequence
  Representative cyclic modulating agent based on cadherin-12 cell adhesion recognition sequence
CFTIDETC

SEQ ID NO: 1746 - protein, 9 aa, Artificial Sequence
  Representative cyclic modulating agent based on cadherin-12 cell adhesion recognition sequence
CFTIDETTC

SEQ ID NO: 1747 - protein, 10 aa, Artificial Sequence
  Representative cyclic modulating agent based on cadherin-12 cell adhesion recognition sequence
CFTIDETTGC

SEQ ID NO: 1748 - protein, 9 aa, Artificial Sequence
  Representative cyclic modulating agent based on cadherin-12 cell adhesion recognition sequence
CVFTIDETC

SEQ ID NO: 1749 - protein, 10 aa, Artificial Sequence
  Representative cyclic modulating agent based on cadherin-12 cell adhesion recognition sequence
CVFTIDETTC

SEQ ID NO: 1750 - protein, 11 aa, Artificial Sequence
  Representative cyclic modulating agent based on cadherin-12 cell adhesion recognition sequence
CVFTIDETTGC

SEQ ID NO: 1751 - protein, 6 aa, Artificial Sequence
  Representative cyclic modulating agent based on cadherin-12 cell adhesion recognition sequence
DDETTK

SEQ ID NO: 1752 - protein, 5 aa, Artificial Sequence
  Representative cyclic modulating agent based on cadherin-12 cell adhesion recognition sequence
DDETK

SEQ ID NO: 1753 - protein, 6 aa, Artificial Sequence
  Representative cyclic modulating agent based on cadherin-12 cell adhesion recognition sequence
DIDETK

SEQ ID NO: 1754 - protein, 7 aa, Artificial Sequence
  Representative cyclic modulating agent based on cadherin-12 cell adhesion recognition sequence
DTIDETK

SEQ ID NO: 1755 - protein, 8 aa, Artificial Sequence
  Representative cyclic modulating agent based on cadherin-12 cell adhesion recognition sequence
DFTIDETK

SEQ ID NO: 1756 - protein, 9 aa, Artificial Sequence
  Representative cyclic modulating agent based on cadherin-12 cell adhesion recognition sequence
DVFTIDETK

SEQ ID NO: 1757 - protein, 5 aa, Artificial Sequence
  Representative cyclic modulating agent based on cadherin-12 cell adhesion recognition sequence
EDETK

SEQ ID NO: 1758 - protein, 6 aa, Artificial Sequence
  Representative cyclic modulating agent based on cadherin-12 cell adhesion recognition sequence
EIDETK

SEQ ID NO: 1759 - protein, 7 aa, Artificial Sequence
  Representative cyclic modulating agent based on cadherin-12 cell adhesion recognition sequence
ETIDETK

SEQ ID NO: 1760 - protein, 8 aa, Artificial Sequence
  Representative cyclic modulating agent based on cadherin-12 cell adhesion recognition sequence
EFTIDETK

SEQ ID NO: 1761 - protein, 9 aa, Artificial Sequence
  Representative cyclic modulating agent based on cadherin-12 cell adhesion recognition sequence
EVFTIDETK

SEQ ID NO: 1762 - protein, 5 aa, Artificial Sequence
  Representative cyclic modulating agent based on cadherin-12 cell adhesion recognition sequence
KDETD

SEQ ID NO: 1763 - protein, 6 aa, Artificial Sequence
  Representative cyclic modulating agent based on cadherin-12 cell adhesion recognition sequence
KIDETD

SEQ ID NO: 1764 - protein, 6 aa, Artificial Sequence
  Representative cyclic modulating agent based on cadherin-12 cell adhesion recognition sequence
KDETTD

SEQ ID NO: 1765 - protein, 7 aa, Artificial Sequence
  Representative cyclic modulating agent based on cadherin-12 cell adhesion recognition sequence
KTIDETD

SEQ ID NO: 1766 - protein, 7 aa, Artificial Sequence
  Representative cyclic modulating agent based on cadherin-12 cell adhesion recognition sequence
KIDETTD

SEQ ID NO: 1767 - protein, 8 aa, Artificial Sequence
  Representative cyclic modulating agent based on cadherin-12 cell adhesion recognition sequence
KTIDETTD

SEQ ID NO: 1768 - protein, 7 aa, Artificial Sequence
  Representative cyclic modulating agent based on cadherin-12 cell adhesion recognition sequence
KDETTGD

SEQ ID NO: 1769 - protein, 8 aa, Artificial Sequence
  Representative cyclic modulating agent based on cadherin-12 cell adhesion recognition sequence
KIDETTGD

SEQ ID NO: 1770 - protein, 9 aa, Artificial Sequence
  Representative cyclic modulating agent based on cadherin-12 cell adhesion recognition sequence
KTIDETTGD

SEQ ID NO: 1771 - protein, 8 aa, Artificial Sequence
  Representative cyclic modulating agent based on cadherin-12 cell adhesion recognition sequence
KFTIDETD

SEQ ID NO: 1772 - protein, 9 aa, Artificial Sequence
  Representative cyclic modulating agent based on cadherin-12 cell adhesion recognition sequence
KFTIDETTD

SEQ ID NO: 1773 - protein, 10 aa, Artificial Sequence
  Representative cyclic modulating agent based on cadherin-12 cell adhesion recognition sequence
KFTIDETTGD

SEQ ID NO: 1774 - protein, 9 aa, Artificial Sequence
  Representative cyclic modulating agent based on cadherin-12 cell adhesion recognition sequence
KVFTIDETD

SEQ ID NO: 1775 - protein, 10 aa, Artificial Sequence
  Representative cyclic modulating agent based on cadherin-12 cell adhesion recognition sequence
KVFTIDETTD

SEQ ID NO: 1776 - protein, 11 aa, Artificial Sequence
  Representative cyclic modulating agent based on cadherin-12 cell adhesion recognition sequence
KVFTIDETTGD

SEQ ID NO: 1777 - protein, 7 aa, Artificial Sequence
  Representative cyclic modulating agent based on cadherin-12 cell adhesion recognition sequence
DIDETTK

SEQ ID NO: 1778 - protein, 5 aa, Artificial Sequence
  Representative cyclic modulating agent based on cadherin-12 cell adhesion recognition sequence
IDETT

SEQ ID NO: 1779 - protein, 6 aa, Artificial Sequence
  Representative cyclic modulating agent based on cadherin-12 cell adhesion recognition sequence
TIDETT

SEQ ID NO: 1780 - protein, 5 aa, Artificial Sequence
  Representative cyclic modulating agent based on cadherin-12 cell adhesion recognition sequence
DETTG

SEQ ID NO: 1781 - protein, 6 aa, Artificial Sequence
  Representative cyclic modulating agent based on cadherin-12 cell adhesion recognition sequence
IDETTG

SEQ ID NO: 1782 - protein, 5 aa, Artificial Sequence
  Representative cyclic modulating agent based on cadherin-12 cell adhesion recognition sequence
KDETE

SEQ ID NO: 1783 - protein, 6 aa, Artificial Sequence
  Representative cyclic modulating agent based on cadherin-12 cell adhesion recognition sequence
KIDETE

SEQ ID NO: 1784 - protein, 6 aa, Artificial Sequence
  Representative cyclic modulating agent based on cadherin-12 cell adhesion recognition sequence
KDETTE

SEQ ID NO: 1785 - protein, 7 aa, Artificial Sequence
  Representative cyclic modulating agent based on cadherin-12 cell adhesion recognition sequence
KTIDETE

SEQ ID NO: 1786 - protein, 7 aa, Artificial Sequence
  Representative cyclic modulating agent based on cadherin-12 cell adhesion recognition sequence
KIDETTE

SEQ ID NO: 1787 - protein, 8 aa, Artificial Sequence
  Representative cyclic modulating agent based on cadherin-12 cell adhesion recognition sequence
KTIDETTE

SEQ ID NO: 1788 - protein, 7 aa, Artificial Sequence
  Representative cyclic modulating agent based on cadherin-12 cell adhesion recognition sequence
KDETTGE

SEQ ID NO: 1789 - protein, 8 aa, Artificial Sequence
  Representative cyclic modulating agent based on cadherin-12 cell adhesion recognition sequence
KIDETTGE

SEQ ID NO: 1790 - protein, 9 aa, Artificial Sequence
  Representative cyclic modulating agent based on cadherin-12 cell adhesion recognition sequence
KTIDETTGE

SEQ ID NO: 1791 - protein, 8 aa, Artificial Sequence
  Representative cyclic modulating agent based on cadherin-12 cell adhesion recognition sequence
KFTIDETE

SEQ ID NO: 1792 - protein, 9 aa, Artificial Sequence
  Representative cyclic modulating agent based on cadherin-12 cell adhesion recognition sequence
KFTIDETTE

SEQ ID NO: 1793 - protein, 10 aa, Artificial Sequence
  Representative cyclic modulating agent based on cadherin-12 cell adhesion recognition sequence
KFTIDETTGE

SEQ ID NO: 1794 - protein, 9 aa, Artificial Sequence
  Representative cyclic modulating agent based on cadherin-12 cell adhesion recognition sequence
KVFTIDETE

SEQ ID NO: 1795 - protein, 10 aa, Artificial Sequence
  Representative cyclic modulating agent based on cadherin-12 cell adhesion recognition sequence
KIFTIDETTE

SEQ ID NO: 1796 - protein, 11 aa, Artificial Sequence
  Representative cyclic modulating agent based on cadherin-12 cell adhesion recognition sequence
KVFTIDETTGE

SEQ ID NO: 1797 - protein, 5 aa, Artificial Sequence
  Representative cyclic modulating agent based on cadherin-12 cell adhesion recognition sequence
CDPKC

SEQ ID NO: 1798 - protein, 6 aa, Artificial Sequence
  Representative cyclic modulating agent based on cadherin-12 cell adhesion recognition sequence
CDPKTC

SEQ ID NO: 1799 - protein, 7 aa, Artificial Sequence
  Representative cyclic modulating agent based on cadherin-12 cell adhesion recognition sequence
CDPKTGC

SEQ ID NO: 1800 - protein, 6 aa, Artificial Sequence
  Representative cyclic modulating agent based on cadherin-12 cell adhesion recognition sequence
CIDPKC

SEQ ID NO: 1801 - protein, 7 aa, Artificial Sequence
  Representative cyclic modulating agent based on cadherin-12 cell adhesion recognition sequence
CIDPKTC

SEQ ID NO: 1802 - protein, 8 aa, Artificial Sequence
  Representative cyclic modulating agent based on cadherin-12 cell adhesion recognition sequence
CIDPKTGC

SEQ ID NO: 1803 - protein, 7 aa, Artificial Sequence
  Representative cyclic modulating agent based on cadherin-12 cell adhesion recognition sequence
CSIDPKC

SEQ ID NO: 1804 - protein, 8 aa, Artificial Sequence
  Representative cyclic modulating agent based on cadherin-12 cell adhesion recognition sequence
CSIDPKTC

SEQ ID NO: 1805 - protein, 9 aa, Artificial Sequence
  Representative cyclic modulating agent based on cadherin-12 cell adhesion recognition sequence
CSIDPKTGC

SEQ ID NO: 1806 - protein, 8 aa, Artificial Sequence
  Representative cyclic modulating agent based on cadherin-12 cell adhesion recognition sequence
CFSIDPKC

SEQ ID NO: 1807 - protein, 9 aa, Artificial Sequence
  Representative cyclic modulating agent based on cadherin-12 cell adhesion recognition sequence
CFSIDPKTC

SEQ ID NO: 1808 - protein, 10 aa, Artificial Sequence
  Representative cyclic modulating agent based on cadherin-12 cell adhesion recognition sequence
CFSIDPKTGC

SEQ ID NO: 1809 - protein, 9 aa, Artificial Sequence
  Representative cyclic modulating agent based on cadherin-12 cell adhesion recognition sequence
CYFSIDPKC

SEQ ID NO: 1810 - protein, 10 aa, Artificial Sequence
  Representative cyclic modulating agent based on cadherin-12 cell adhesion recognition sequence
CYFSIDPKTC

SEQ ID NO: 1811 - protein, 11 aa, Artificial Sequence
  Representative cyclic modulating agent based on cadherin-12 cell adhesion recognition sequence
CYFSIDPKTGC

SEQ ID NO: 1812 - protein, 5 aa, Artificial Sequence
  Representative cyclic modulating agent based on cadherin-12 cell adhesion recognition sequence
EDPKK

SEQ ID NO: 1813 - protein, 6 aa, Artificial Sequence
  Representative cyclic modulating agent based on cadherin-12 cell adhesion recognition sequence
EDPKTK

SEQ ID NO: 1814 - protein, 7 aa, Artificial Sequence
  Representative cyclic modulating agent based on cadherin-12 cell adhesion recognition sequence
EDPKTGK

SEQ ID NO: 1815 - protein, 6 aa, Artificial Sequence
  Representative cyclic modulating agent based on cadherin-12 cell adhesion recognition sequence
EIDPKK

SEQ ID NO: 1816 - protein, 7 aa, Artificial Sequence
  Representative cyclic modulating agent based on cadherin-12 cell adhesion recognition sequence
EIDPKTK

SEQ ID NO: 1817 - protein, 8 aa, Artificial Sequence
  Representative cyclic modulating agent based on cadherin-12 cell adhesion recognition sequence
EIDPKTGK

SEQ ID NO: 1818 - protein, 7 aa, Artificial Sequence
  Representative cyclic modulating agent based on cadherin-12 cell adhesion recognition sequence
ESIDPKK

SEQ ID NO: 1819 - protein, 8 aa, Artificial Sequence
  Representative cyclic modulating agent based on cadherin-12 cell adhesion recognition sequence
ESIDPKTK

SEQ ID NO: 1820 - protein, 9 aa, Artificial Sequence
  Representative cyclic modulating agent based on cadherin-12 cell adhesion recognition sequence
ESIDPKTGK

SEQ ID NO: 1821 - protein, 8 aa, Artificial Sequence
  Representative cyclic modulating agent based on cadherin-12 cell adhesion recognition sequence
EFSIDPKK

SEQ ID NO: 1822 - protein, 9 aa, Artificial Sequence
  Representative cyclic modulating agent based on cadherin-12 cell adhesion recognition sequence
EFSIDPKTK

SEQ ID NO: 1823 - protein, 10 aa, Artificial Sequence
  Representative cyclic modulating agent based on cadherin-12 cell adhesion recognition sequence
EFSIDPKTGK

SEQ ID NO: 1824 - protein, 9 aa, Artificial Sequence
  Representative cyclic modulating agent based on cadherin-12 cell adhesion recognition sequence
EYFSIDPKK

SEQ ID NO: 1825 - protein, 10 aa, Artificial Sequence
  Representative cyclic modulating agent based on cadherin-12 cell adhesion recognition sequence
EYFSIDPKTK

SEQ ID NO: 1826 - protein, 11 aa, Artificial Sequence
  Representative cyclic modulating agent based on cadherin-12 cell adhesion recognition sequence
EYFSIDPKTGK

SEQ ID NO: 1827 - protein, 5 aa, Artificial Sequence
  Representative cyclic modulating agent based on cadherin-12 cell adhesion recognition sequence
KDPKD

SEQ ID NO: 1828 - protein, 6 aa, Artificial Sequence
  Representative cyclic modulating agent based on cadherin-12 cell adhesion recognition sequence
KDPKTD

SEQ ID NO: 1829 - protein, 7 aa, Artificial Sequence
  Representative cyclic modulating agent based on cadherin-12 cell adhesion recognition sequence
KDPKTGD

SEQ ID NO: 1830 - protein, 6 aa, Artificial Sequence
  Representative cyclic modulating agent based on cadherin-12 cell adhesion recognition sequence
KIDPKD

SEQ ID NO: 1831 - protein, 7 aa, Artificial Sequence
  Representative cyclic modulating agent based on cadherin-12 cell adhesion recognition sequence
KIDPKTD

SEQ ID NO: 1832 - protein, 8 aa, Artificial Sequence
  Representative cyclic modulating agent based on cadherin-12 cell adhesion recognition sequence
KIDPKTGD

SEQ ID NO: 1833 - protein, 7 aa, Artificial Sequence
  Representative cyclic modulating agent based on cadherin-12 cell adhesion recognition sequence
KSIDPKD

SEQ ID NO: 1834 - protein, 8 aa, Artificial Sequence
  Representative cyclic modulating agent based on cadherin-12 cell adhesion recognition sequence
KSIDPKTD

SEQ ID NO: 1835 - protein, 9 aa, Artificial Sequence
  Representative cyclic modulating agent based on cadherin-12 cell adhesion recognition sequence
KSIDPKTGD

SEQ ID NO: 1836 - protein, 8 aa, Artificial Sequence
  Representative cyclic modulating agent based on cadherin-12 cell adhesion recognition sequence
KFSIDPKD

SEQ ID NO: 1837 - protein, 9 aa, Artificial Sequence
  Representative cyclic modulating agent based on cadherin-12 cell adhesion recognition sequence
KFSIDPKTD

SEQ ID NO: 1838 - protein, 10 aa, Artificial Sequence
  Representative cyclic modulating agent based on cadherin-12 cell adhesion recognition sequence
KFSIDPKTGD

SEQ ID NO: 1839 - protein, 9 aa, Artificial Sequence
  Representative cyclic modulating agent based on cadherin-12 cell adhesion recognition sequence
KYFSIDPKD

SEQ ID NO: 1840 - protein, 10 aa, Artificial Sequence
  Representative cyclic modulating agent based on cadherin-12 cell adhesion recognition sequence
KYFSIDPKTD

SEQ ID NO: 1841 - protein, 11 aa, Artificial Sequence
  Representative cyclic modulating agent based on cadherin-12 cell adhesion recognition sequence
KYFSIDPKTGD

SEQ ID NO: 1842 - protein, 5 aa, Artificial Sequence
  Representative cyclic modulating agent based on cadherin-12 cell adhesion recognition sequence
DDPKK

SEQ ID NO: 1843 - protein, 6 aa, Artificial Sequence
  Representative cyclic modulating agent based on cadherin-12 cell adhesion recognition sequence
DDPKTK

SEQ ID NO: 1844 - protein, 7 aa, Artificial Sequence
  Representative cyclic modulating agent based on cadherin-12 cell adhesion recognition sequence
DDPKTGK

SEQ ID NO: 1845 - protein, 6 aa, Artificial Sequence
  Representative cyclic modulating agent based on cadherin-12 cell adhesion recognition sequence
DIDPKK

SEQ ID NO: 1846 - protein, 7 aa, Artificial Sequence
  Representative cyclic modulating agent based on cadherin-12 cell adhesion recognition sequence
DIDPKTK

SEQ ID NO: 1847 - protein, 8 aa, Artificial Sequence
  Representative cyclic modulating agent based on cadherin-12 cell adhesion recognition sequence
DIDPKTGK

SEQ ID NO: 1848 - protein, 7 aa, Artificial Sequence
  Representative cyclic modulating agent based on cadherin-12 cell adhesion recognition sequence
DSIDPKK

SEQ ID NO: 1849 - protein, 8 aa, Artificial Sequence
  Representative cyclic modulating agent based on cadherin-12 cell adhesion recognition sequence
DSIDPKTK

SEQ ID NO: 1850 - protein, 9 aa, Artificial Sequence
  Representative cyclic modulating agent based on cadherin-12 cell adhesion recognition sequence
DSIDPKTGK

SEQ ID NO: 1851 - protein, 8 aa, Artificial Sequence
  Representative cyclic modulating agent based on cadherin-12 cell adhesion recognition sequence
DFSIDPKK

SEQ ID NO: 1852 - protein, 9 aa, Artificial Sequence
  Representative cyclic modulating agent based on cadherin-12 cell adhesion recognition sequence
DFSIDPKTK

SEQ ID NO: 1853 - protein, 10 aa, Artificial Sequence
  Representative cyclic modulating agent based on cadherin-12 cell adhesion recognition sequence
DFSIDPKTGK

SEQ ID NO: 1854 - protein, 9 aa, Artificial Sequence
  Representative cyclic modulating agent based on cadherin-12 cell adhesion recognition sequence
DYFSIDPKK

SEQ ID NO: 1855 - protein, 10 aa, Artificial Sequence
  Representative cyclic modulating agent based on cadherin-12 cell adhesion recognition sequence
DYFSIDPKTK

SEQ ID NO: 1856 - protein, 11 aa, Artificial Sequence
  Representative cyclic modulating agent based on cadherin-12 cell adhesion recognition sequence
DYFSIDPKTGK

SEQ ID NO: 1857 - protein, 5 aa, Artificial Sequence
  Representative cyclic modulating agent based on cadherin-12 cell adhesion recognition sequence
KDPKE

SEQ ID NO: 1858 - protein, 6 aa, Artificial Sequence
  Representative cyclic modulating agent based on cadherin-12 cell adhesion recognition sequence
KDPKTE

SEQ ID NO: 1859 - protein, 7 aa, Artificial Sequence
  Representative cyclic modulating agent based on cadherin-12 cell adhesion recognition sequence
KDPKTGE

SEQ ID NO: 1860 - protein, 6 aa, Artificial Sequence
  Representative cyclic modulating agent based on cadherin-12 cell adhesion recognition sequence
KIDPKE

SEQ ID NO: 1861 - protein, 7 aa, Artificial Sequence
  Representative cyclic modulating agent based on cadherin-12 cell adhesion recognition sequence
KIDPKTE

SEQ ID NO: 1862 - protein, 8 aa, Artificial Sequence
  Representative cyclic modulating agent based on cadherin-12 cell adhesion recognition sequence
KIDPKTGE

SEQ ID NO: 1863 - protein, 7 aa, Artificial Sequence
  Representative cyclic modulating agent based on cadherin-12 cell adhesion recognition sequence
KSIDPKE

SEQ ID NO: 1864 - protein, 8 aa, Artificial Sequence
  Representative cyclic modulating agent based on cadherin-12 cell adhesion recognition sequence
KSIDPKTE

SEQ ID NO: 1865 - protein, 9 aa, Artificial Sequence
  Representative cyclic modulating agent based on cadherin-12 cell adhesion recognition sequence
KSIDPKTGE

SEQ ID NO: 1866 - protein, 8 aa, Artificial Sequence
  Representative cyclic modulating agent based on cadherin-12 cell adhesion recognition sequence
KFSIDPKE

SEQ ID NO: 1867 - protein, 9 aa, Artificial Sequence
  Representative cyclic modulating agent based on cadherin-12 cell adhesion recognition sequence
KFSIDPKTE

SEQ ID NO: 1868 - protein, 10 aa, Artificial Sequence
  Representative cyclic modulating agent based on cadherin-12 cell adhesion recognition sequence
KFSIDPKTGE

SEQ ID NO: 1869 - protein, 9 aa, Artificial Sequence
  Representative cyclic modulating agent based on cadherin-12 cell adhesion recognition sequence
KYFSIDPKE

SEQ ID NO: 1870 - protein, 10 aa, Artificial Sequence
  Representative cyclic modulating agent based on cadherin-12 cell adhesion recognition sequence
KYFSIDPKTE

SEQ ID NO: 1871 - protein, 11 aa, Artificial Sequence
  Representative cyclic modulating agent based on cadherin-12 cell adhesion recognition sequence
KYFSIDPKTGE

SEQ ID NO: 1872 - protein, 5 aa, Artificial Sequence
  Representative cyclic modulating agent based on cadherin-12 cell adhesion recognition sequence
DPKTG

SEQ ID NO: 1873 - protein, 5 aa, Artificial Sequence
  Representative cyclic modulating agent based on cadherin-12 cell adhesion recognition sequence
IDPKT

SEQ ID NO: 1874 - protein, 6 aa, Artificial Sequence
  Representative cyclic modulating agent based on cadherin-12 cell adhesion recognition sequence
IDPKTG

SEQ ID NO: 1875 - protein, 5 aa, Artificial Sequence
  Representative cyclic modulating agent based on cadherin-12 cell adhesion recognition sequence
SIDPK

SEQ ID NO: 1876 - protein, 6 aa, Artificial Sequence
  Representative cyclic modulating agent based on cadherin-12 cell adhesion recognition sequence
SIDPKT

SEQ ID NO: 1877 - protein, 7 aa, Artificial Sequence
  Representative cyclic modulating agent based on cadherin-12 cell adhesion recognition sequence
SIDPKTG

SEQ ID NO: 1878 - protein, 6 aa, Artificial Sequence
  Representative cyclic modulating agent based on cadherin-12 cell adhesion recognition sequence
FSIDPK

SEQ ID NO: 1879 - protein, 7 aa, Artificial Sequence
  Representative cyclic modulating agent based on cadherin-12 cell adhesion recognition sequence
FSIDPKT

SEQ ID NO: 1880 - protein, 8 aa, Artificial Sequence
  Representative cyclic modulating agent based on cadherin-12 cell adhesion recognition sequence
FSIDPKTG

SEQ ID NO: 1881 - protein, 7 aa, Artificial Sequence
  Representative cyclic modulating agent based on cadherin-12 cell adhesion recognition sequence
YFSIDPK

SEQ ID NO: 1882 - protein, 8 aa, Artificial Sequence
  Representative cyclic modulating agent based on cadherin-12 cell adhesion recognition sequence
YFSIDPKT

SEQ ID NO: 1883 - protein, 9 aa, Artificial Sequence
  Representative cyclic modulating agent based on cadherin-12 cell adhesion recognition sequence
YFSIDPKTG

SEQ ID NO: 1884 - protein, 5 aa, Artificial Sequence
  Representative cyclic modulating agent based on cadherin-14 cell adhesion recognition sequence
CDDTC

SEQ ID NO: 1885 - protein, 6 aa, Artificial Sequence
  Representative cyclic modulating agent based on cadherin-14 cell adhesion recognition sequence
CIDDTC

SEQ ID NO: 1886 - protein, 6 aa, Artificial Sequence
  Representative cyclic modulating agent based on cadherin-14 cell adhesion recognition sequence
CDDTTC

SEQ ID NO: 1887 - protein, 7 aa, Artificial Sequence
  Representative cyclic modulating agent based on cadherin-14 cell adhesion recognition sequence
CIIDDTC

SEQ ID NO: 1888 - protein, 7 aa, Artificial Sequence
  Representative cyclic modulating agent based on cadherin-14 cell adhesion recognition sequence
CIDDTTC

SEQ ID NO: 1889 - protein, 8 aa, Artificial Sequence
  Representative cyclic modulating agent based on cadherin-14 cell adhesion recognition sequence
CIIDDTTC

SEQ ID NO: 1890 - protein, 7 aa, Artificial Sequence
  Representative cyclic modulating agent based on cadherin-14 cell adhesion recognition sequence
CDDTTGC

SEQ ID NO: 1891 - protein, 8 aa, Artificial Sequence
  Representative cyclic modulating agent based on cadherin-14 cell adhesion recognition sequence
CIDDTTGC

SEQ ID NO: 1892 - protein, 9 aa, Artificial Sequence
  Representative cyclic modulating agent based on cadherin-14 cell adhesion recognition sequence
CIIDDTTGC

SEQ ID NO: 1893 - protein, 8 aa, Artificial Sequence
  Representative cyclic modulating agent based on cadherin-14 cell adhesion recognition sequence
CFIIDDTC

SEQ ID NO: 1894 - protein, 9 aa, Artificial Sequence
  Representative cyclic modulating agent based on cadherin-14 cell adhesion recognition sequence
CFIIDDTTC

SEQ ID NO: 1895 - protein, 10 aa, Artificial Sequence
  Representative cyclic modulating agent based on cadherin-14 cell adhesion recognition sequence
CFIIDDTTGC

SEQ ID NO: 1896 - protein, 9 aa, Artificial Sequence
  Representative cyclic modulating agent based on cadherin-14 cell adhesion recognition sequence
CIFIIDDTC

SEQ ID NO: 1897 - protein, 10 aa, Artificial Sequence
  Representative cyclic modulating agent based on cadherin-14 cell adhesion recognition sequence
CIFIIDDTTC

SEQ ID NO: 1898 - protein, 11 aa, Artificial Sequence
  Representative cyclic modulating agent based on cadherin-14 cell adhesion recognition sequence
CIFIIDDTTGC

SEQ ID NO: 1899 - protein, 6 aa, Artificial Sequence
  Representative cyclic modulating agent based on cadherin-14 cell adhesion recognition sequence
EDDTTK

SEQ ID NO: 1900 - protein, 5 aa, Artificial Sequence
  Representative cyclic modulating agent based on cadherin-14 cell adhesion recognition sequence
DDDTK

SEQ ID NO: 1901 - protein, 7 aa, Artificial Sequence
  Representative cyclic modulating agent based on cadherin-14 cell adhesion recognition sequence
DIDDTNK

SEQ ID NO: 1902 - protein, 7 aa, Artificial Sequence
  Representative cyclic modulating agent based on cadherin-14 cell adhesion recognition sequence
DIIDDTK

SEQ ID NO: 1903 - protein, 8 aa, Artificial Sequence
  Representative cyclic modulating agent based on cadherin-14 cell adhesion recognition sequence
DFIIDDTK

SEQ ID NO: 1904 - protein, 9 aa, Artificial Sequence
  Representative cyclic modulating agent based on cadherin-14 cell adhesion recognition sequence
DIFIIDDTK

SEQ ID NO: 1905 - protein, 5 aa, Artificial Sequence
  Representative cyclic modulating agent based on cadherin-14 cell adhesion recognition sequence
EDDTK

SEQ ID NO: 1906 - protein, 6 aa, Artificial Sequence
  Representative cyclic modulating agent based on cadherin-14 cell adhesion recognition sequence
EIDDTK

SEQ ID NO: 1907 - protein, 7 aa, Artificial Sequence
  Representative cyclic modulating agent based on cadherin-14 cell adhesion recognition sequence
EIIDDTK

SEQ ID NO: 1908 - protein, 8 aa, Artificial Sequence
  Representative cyclic modulating agent based on cadherin-14 cell adhesion recognition sequence
EFIIDDTK

SEQ ID NO: 1909 - protein, 9 aa, Artificial Sequence
  Representative cyclic modulating agent based on cadherin-14 cell adhesion recognition sequence
EIFIIDDTK

SEQ ID NO: 1910 - protein, 5 aa, Artificial Sequence
  Representative cyclic modulating agent based on cadherin-14 cell adhesion recognition sequence
KDDTD

SEQ ID NO: 1911 - protein, 6 aa, Artificial Sequence
  Representative cyclic modulating agent based on cadherin-14 cell adhesion recognition sequence
KIDDTD

SEQ ID NO: 1912 - protein, 6 aa, Artificial Sequence
  Representative cyclic modulating agent based on cadherin-14 cell adhesion recognition sequence
KDDTTD

SEQ ID NO: 1913 - protein, 7 aa, Artificial Sequence
  Representative cyclic modulating agent based on cadherin-14 cell adhesion recognition sequence
KIIDDTD

SEQ ID NO: 1914 - protein, 7 aa, Artificial Sequence
  Representative cyclic modulating agent based on cadherin-14 cell adhesion recognition sequence
KIDDTTD

SEQ ID NO: 1915 - protein, 8 aa, Artificial Sequence
  Representative cyclic modulating agent based on cadherin-14 cell adhesion recognition sequence
KIIDDTTD

SEQ ID NO: 1916 - protein, 7 aa, Artificial Sequence
  Representative cyclic modulating agent based on cadherin-14 cell adhesion recognition sequence
KDDTTGD

SEQ ID NO: 1917 - protein, 8 aa, Artificial Sequence
  Representative cyclic modulating agent based on cadherin-14 cell adhesion recognition sequence
KIDDTTGD

SEQ ID NO: 1918 - protein, 9 aa, Artificial Sequence
  Representative cyclic modulating agent based on cadherin-14 cell adhesion recognition sequence
KIIDDTTGD

SEQ ID NO: 1919 - protein, 8 aa, Artificial Sequence
  Representative cyclic modulating agent based on cadherin-14 cell adhesion recognition sequence
KFIIDDTD

SEQ ID NO: 1920 - protein, 9 aa, Artificial Sequence
  Representative cyclic modulating agent based on cadherin-14 cell adhesion recognition sequence
KFIIDDTTD

SEQ ID NO: 1921 - protein, 10 aa, Artificial Sequence
  Representative cyclic modulating agent based on cadherin-14 cell adhesion recognition sequence
KFIIDDTTGD

SEQ ID NO: 1922 - protein, 9 aa, Artificial Sequence
  Representative cyclic modulating agent based on cadherin-14 cell adhesion recognition sequence
KIFIIDDTD

SEQ ID NO: 1923 - protein, 10 aa, Artificial Sequence
  Representative cyclic modulating agent based on cadherin-14 cell adhesion recognition sequence
KIFIIDDTTD

SEQ ID NO: 1924 - protein, 11 aa, Artificial Sequence
  Representative cyclic modulating agent based on cadherin-14 cell adhesion recognition sequence
KIFIIDDTTGD

SEQ ID NO: 1925 - protein, 4 aa, Artificial Sequence
  Representative cyclic modulating agent based on cadherin-14 cell adhesion recognition sequence
DDTT

SEQ ID NO: 1926 - protein, 5 aa, Artificial Sequence
  Representative cyclic modulating agent based on cadherin-14 cell adhesion recognition sequence
IDDTT

SEQ ID NO: 1927 - protein, 6 aa, Artificial Sequence
  Representative cyclic modulating agent based on cadherin-14 cell adhesion recognition sequence
IIDDTT

SEQ ID NO: 1928 - protein, 5 aa, Artificial Sequence
  Representative cyclic modulating agent based on cadherin-14 cell adhesion recognition sequence
DDTTG

SEQ ID NO: 1929 - protein, 6 aa, Artificial Sequence
  Representative cyclic modulating agent based on cadherin-14 cell adhesion recognition sequence
IDDTTG

SEQ ID NO: 1930 - protein, 5 aa, Artificial Sequence
  Representative cyclic modulating agent based on cadherin-14 cell adhesion recognition sequence
KDDTE

SEQ ID NO: 1931 - protein, 6 aa, Artificial Sequence
  Representative cyclic modulating agent based on cadherin-14 cell adhesion recognition sequence
KIDDTE

SEQ ID NO: 1932 - protein, 6 aa, Artificial Sequence
  Representative cyclic modulating agent based on cadherin-14 cell adhesion recognition sequence
KDDTTE

SEQ ID NO: 1933 - protein, 7 aa, Artificial Sequence
  Representative cyclic modulating agent based on cadherin-14 cell adhesion recognition sequence
KIIDDTE

SEQ ID NO: 1934 - protein, 7 aa, Artificial Sequence
  Representative cyclic modulating agent based on cadherin-14 cell adhesion recognition sequence
KIDDTTE

SEQ ID NO: 1935 - protein, 8 aa, Artificial Sequence
  Representative cyclic modulating agent based on cadherin-14 cell adhesion recognition sequence
KIIDDTTE

SEQ ID NO: 1936 - protein, 7 aa, Artificial Sequence
  Representative cyclic modulating agent based on cadherin-14 cell adhesion recognition sequence
KDDTTGE

SEQ ID NO: 1937 - protein, 8 aa, Artificial Sequence
  Representative cyclic modulating agent based on cadherin-14 cell adhesion recognition sequence
KIDDTTGE

SEQ ID NO: 1938 - protein, 9 aa, Artificial Sequence
  Representative cyclic modulating agent based on cadherin-14 cell adhesion recognition sequence
KIIDDTTGE

SEQ ID NO: 1939 - protein, 8 aa, Artificial Sequence
  Representative cyclic modulating agent based on cadherin-14 cell adhesion recognition sequence
KFIIDDTE

SEQ ID NO: 1940 - protein, 9 aa, Artificial Sequence
  Representative cyclic modulating agent based on cadherin-14 cell adhesion recognition sequence
KFIIDDTTE

SEQ ID NO: 1941 - protein, 10 aa, Artificial Sequence
  Representative cyclic modulating agent based on cadherin-14 cell adhesion recognition sequence
KFIIDDTTGE

SEQ ID NO: 1942 - protein, 9 aa, Artificial Sequence
  Representative cyclic modulating agent based on cadherin-14 cell adhesion recognition sequence
KIFIIDDTE

SEQ ID NO: 1943 - protein, 10 aa, Artificial Sequence
  Representative cyclic modulating agent based on cadherin-14 cell adhesion recognition sequence
KIFIIDDTTE

SEQ ID NO: 1944 - protein, 11 aa, Artificial Sequence
  Representative cyclic modulating agent based on cadherin-14 cell adhesion recognition sequence
KIFIIDDTTGE

SEQ ID NO: 1945 - protein, 5 aa, Artificial Sequence
  Representative cyclic modulating agent based on cadherin-14 cell adhesion recognition sequence
CDPKC

SEQ ID NO: 1946 - protein, 6 aa, Artificial Sequence
  Representative cyclic modulating agent based on cadherin-14 cell adhesion recognition sequence
CVDPKC

SEQ ID NO: 1947 - protein, 7 aa, Artificial Sequence
  Representative cyclic modulating agent based on cadherin-14 cell adhesion recognition sequence
CVDPKTC

SEQ ID NO: 1948 - protein, 8 aa, Artificial Sequence
  Representative cyclic modulating agent based on cadherin-14 cell adhesion recognition sequence
CVDPKTGC

SEQ ID NO: 1949 - protein, 7 aa, Artificial Sequence
  Representative cyclic modulating agent based on cadherin-14 cell adhesion recognition sequence
CSVDPKC

SEQ ID NO: 1950 - protein, 8 aa, Artificial Sequence
  Representative cyclic modulating agent based on cadherin-14 cell adhesion recognition sequence
CSVDPKTC

SEQ ID NO: 1951 - protein, 9 aa, Artificial Sequence
  Representative cyclic modulating agent based on cadherin-14 cell adhesion recognition sequence
CSVDPKTGC

SEQ ID NO: 1952 - protein, 8 aa, Artificial Sequence
  Representative cyclic modulating agent based on cadherin-14 cell adhesion recognition sequence
CFSVDPKC

SEQ ID NO: 1953 - protein, 9 aa, Artificial Sequence
  Representative cyclic modulating agent based on cadherin-14 cell adhesion recognition sequence
CFSVDPKTC

SEQ ID NO: 1954 - protein, 10 aa, Artificial Sequence
  Representative cyclic modulating agent based on cadherin-14 cell adhesion recognition sequence
CFSVDPKTGC

SEQ ID NO: 1955 - protein, 9 aa, Artificial Sequence
  Representative cyclic modulating agent based on cadherin-14 cell adhesion recognition sequence
CYFSVDPKC

SEQ ID NO: 1956 - protein, 10 aa, Artificial Sequence
  Representative cyclic modulating agent based on cadherin-14 cell adhesion recognition sequence
CYFSVDPKTC

SEQ ID NO: 1957 - protein, 11 aa, Artificial Sequence
  Representative cyclic modulating agent based on cadherin-14 cell adhesion recognition sequence
CYFSVDPKTGC

SEQ ID NO: 1958 - protein, 5 aa, Artificial Sequence
  Representative cyclic modulating agent based on cadherin-14 cell adhesion recognition sequence
CDANC

SEQ ID NO: 1959 - protein, 6 aa, Artificial Sequence
  Representative cyclic modulating agent based on cadherin-14 cell adhesion recognition sequence
CDANTC

SEQ ID NO: 1960 - protein, 7 aa, Artificial Sequence
  Representative cyclic modulating agent based on cadherin-14 cell adhesion recognition sequence
CDANTGC

SEQ ID NO: 1961 - protein, 7 aa, Artificial Sequence
  Representative cyclic modulating agent based on cadherin-14 cell adhesion recognition sequence
CIDANTC

SEQ ID NO: 1962 - protein, 8 aa, Artificial Sequence
  Representative cyclic modulating agent based on cadherin-14 cell adhesion recognition sequence
CIDANTGC

SEQ ID NO: 1963 - protein, 8 aa, Artificial Sequence
  Representative cyclic modulating agent based on cadherin-14 cell adhesion recognition sequence
CNIDANTC

SEQ ID NO: 1964 - protein, 9 aa, Artificial Sequence
  Representative cyclic modulating agent based on cadherin-14 cell adhesion recognition sequence
CNIDANTGC

SEQ ID NO: 1965 - protein, 9 aa, Artificial Sequence
  Representative cyclic modulating agent based on cadherin-14 cell adhesion recognition sequence
CFNIDANTC

SEQ ID NO: 1966 - protein, 10 aa, Artificial Sequence
  Representative cyclic modulating agent based on cadherin-14 cell adhesion recognition sequence
CFNIDANTGC

SEQ ID NO: 1967 - protein, 9 aa, Artificial Sequence
  Representative cyclic modulating agent based on cadherin-14 cell adhesion recognition sequence
CFFNIDANC

SEQ ID NO: 1968 - protein, 10 aa, Artificial Sequence
  Representative cyclic modulating agent based on cadherin-14 cell adhesion recognition sequence
CFFNIDANTC

SEQ ID NO: 1969 - protein, 11 aa, Artificial Sequence
  Representative cyclic modulating agent based on cadherin-14 cell adhesion recognition sequence
CFFNIDANTGC

SEQ ID NO: 1970 - protein, 5 aa, Artificial Sequence
  Representative cyclic modulating agent based on cadherin-14 cell adhesion recognition sequence
EDPKK

SEQ ID NO: 1971 - protein, 6 aa, Artificial Sequence
  Representative cyclic modulating agent based on cadherin-14 cell adhesion recognition sequence
EDPKTK

SEQ ID NO: 1972 - protein, 7 aa, Artificial Sequence
  Representative cyclic modulating agent based on cadherin-14 cell adhesion recognition sequence
EDPKTGK

SEQ ID NO: 1973 - protein, 6 aa, Artificial Sequence
  Representative cyclic modulating agent based on cadherin-14 cell adhesion recognition sequence
EVDPKK

SEQ ID NO: 1974 - protein, 7 aa, Artificial Sequence
  Representative cyclic modulating agent based on cadherin-14 cell adhesion recognition sequence
EVDPKTK

SEQ ID NO: 1975 - protein, 8 aa, Artificial Sequence
  Representative cyclic modulating agent based on cadherin-14 cell adhesion recognition sequence
EVDPKTGK

SEQ ID NO: 1976 - protein, 7 aa, Artificial Sequence
  Representative cyclic modulating agent based on cadherin-14 cell adhesion recognition sequence
ESVDPKK

SEQ ID NO: 1977 - protein, 8 aa, Artificial Sequence
  Representative cyclic modulating agent based on cadherin-14 cell adhesion recognition sequence
ESVDPKTK

SEQ ID NO: 1978 - protein, 9 aa, Artificial Sequence
  Representative cyclic modulating agent based on cadherin-14 cell adhesion recognition sequence
ESVDPKTGK

SEQ ID NO: 1979 - protein, 8 aa, Artificial Sequence
  Representative cyclic modulating agent based on cadherin-14 cell adhesion recognition sequence
EFSVDPKK

SEQ ID NO: 1980 - protein, 9 aa, Artificial Sequence
  Representative cyclic modulating agent based on cadherin-14 cell adhesion recognition sequence
EFSVDPKTK

SEQ ID NO: 1981 - protein, 10 aa, Artificial Sequence
  Representative cyclic modulating agent based on cadherin-14 cell adhesion recognition sequence
EFSVDPKTGK

SEQ ID NO: 1982 - protein, 9 aa, Artificial Sequence
  Representative cyclic modulating agent based on cadherin-14 cell adhesion recognition sequence
EYFSVDPKK

SEQ ID NO: 1983 - protein, 10 aa, Artificial Sequence
  Representative cyclic modulating agent based on cadherin-14 cell adhesion recognition sequence
EYFSVDPKTK

SEQ ID NO: 1984 - protein, 11 aa, Artificial Sequence
  Representative cyclic modulating agent based on cadherin-14 cell adhesion recognition sequence
EYFSVDPKTGK

SEQ ID NO: 1985 - protein, 5 aa, Artificial Sequence
  Representative cyclic modulating agent based on cadherin-14 cell adhesion recognition sequence
EDANK

SEQ ID NO: 1986 - protein, 6 aa, Artificial Sequence
  Representative cyclic modulating agent based on cadherin-14 cell adhesion recognition sequence
EDANTK

SEQ ID NO: 1987 - protein, 7 aa, Artificial Sequence
  Representative cyclic modulating agent based on cadherin-14 cell adhesion recognition sequence
EDANTGK

SEQ ID NO: 1988 - protein, 7 aa, Artificial Sequence
  Representative cyclic modulating agent based on cadherin-14 cell adhesion recognition sequence
EIDANTK

SEQ ID NO: 1989 - protein, 8 aa, Artificial Sequence
  Representative cyclic modulating agent based on cadherin-14 cell adhesion recognition sequence
EIDANTGK

SEQ ID NO: 1990 - protein, 8 aa, Artificial Sequence
  Representative cyclic modulating agent based on cadherin-14 cell adhesion recognition sequence
ENIDANTK

SEQ ID NO: 1991 - protein, 9 aa, Artificial Sequence
  Representative cyclic modulating agent based on cadherin-14 cell adhesion recognition sequence
ENIDANTGK

SEQ ID NO: 1992 - protein, 9 aa, Artificial Sequence
  Representative cyclic modulating agent based on cadherin-14 cell adhesion recognition sequence
EFNIDANTK

SEQ ID NO: 1993 - protein, 10 aa, Artificial Sequence
  Representative cyclic modulating agent based on cadherin-14 cell adhesion recognition sequence
EFNIDANTGK

SEQ ID NO: 1994 - protein, 9 aa, Artificial Sequence
  Representative cyclic modulating agent based on cadherin-14 cell adhesion recognition sequence
EFFNIDANK

SEQ ID NO: 1995 - protein, 10 aa, Artificial Sequence
  Representative cyclic modulating agent based on cadherin-14 cell adhesion recognition sequence
EFFNIDANTK

SEQ ID NO: 1996 - protein, 11 aa, Artificial Sequence
  Representative cyclic modulating agent based on cadherin-14 cell adhesion recognition sequence
EFFNIDANTGK

SEQ ID NO: 1997 - protein, 6 aa, Artificial Sequence
  Representative cyclic modulating agent based on cadherin-14 cell adhesion recognition sequence
KVDPKD

SEQ ID NO: 1998 - protein, 7 aa, Artificial Sequence
  Representative cyclic modulating agent based on cadherin-14 cell adhesion recognition sequence
KVDPKTD

SEQ ID NO: 1999 - protein, 8 aa, Artificial Sequence
  Representative cyclic modulating agent based on cadherin-14 cell adhesion recognition sequence
KVDPKTGD

SEQ ID NO: 2000 - protein, 7 aa, Artificial Sequence
  Representative cyclic modulating agent based on cadherin-14 cell adhesion recognition sequence
KSVDPKD

SEQ ID NO: 2001 - protein, 8 aa, Artificial Sequence
  Representative cyclic modulating agent based on cadherin-14 cell adhesion recognition sequence
KSVDPKTD

SEQ ID NO: 2002 - protein, 9 aa, Artificial Sequence
  Representative cyclic modulating agent based on cadherin-14 cell adhesion recognition sequence
KSVDPKTGD

SEQ ID NO: 2003 - protein, 8 aa, Artificial Sequence
  Representative cyclic modulating agent based on cadherin-14 cell adhesion recognition sequence
KFSVDPKD

SEQ ID NO: 2004 - protein, 9 aa, Artificial Sequence
  Representative cyclic modulating agent based on cadherin-14 cell adhesion recognition sequence
KFSVDPKTD

SEQ ID NO: 2005 - protein, 10 aa, Artificial Sequence
  Representative cyclic modulating agent based on cadherin-14 cell adhesion recognition sequence
KFSVDPKTGD

SEQ ID NO: 2006 - protein, 9 aa, Artificial Sequence
  Representative cyclic modulating agent based on cadherin-14 cell adhesion recognition sequence
KYFSVDPKD

SEQ ID NO: 2007 - protein, 10 aa, Artificial Sequence
  Representative cyclic modulating agent based on cadherin-14 cell adhesion recognition sequence
KYFSVDPKTD

SEQ ID NO: 2008 - protein, 11 aa, Artificial Sequence
  Representative cyclic modulating agent based on cadherin-14 cell adhesion recognition sequence
KYFSVDPKTGD

SEQ ID NO: 2009 - protein, 6 aa, Artificial Sequence
  Representative cyclic modulating agent based on cadherin-14 cell adhesion recognition sequence
KDANTD

SEQ ID NO: 2010 - protein, 7 aa, Artificial Sequence
  Representative cyclic modulating agent based on cadherin-14 cell adhesion recognition sequence
KDANTGD

SEQ ID NO: 2011 - protein, 7 aa, Artificial Sequence
  Representative cyclic modulating agent based on cadherin-14 cell adhesion recognition sequence
KIDANTD

SEQ ID NO: 2012 - protein, 8 aa, Artificial Sequence
  Representative cyclic modulating agent based on cadherin-14 cell adhesion recognition sequence
KIDANTGD

SEQ ID NO: 2013 - protein, 8 aa, Artificial Sequence
  Representative cyclic modulating agent based on cadherin-14 cell adhesion recognition sequence
KNIDANTD

SEQ ID NO: 2014 - protein, 9 aa, Artificial Sequence
  Representative cyclic modulating agent based on cadherin-14 cell adhesion recognition sequence
KNIDANTGD

SEQ ID NO: 2015 - protein, 9 aa, Artificial Sequence
  Representative cyclic modulating agent based on cadherin-14 cell adhesion recognition sequence
KFNIDANTD

SEQ ID NO: 2016 - protein, 10 aa, Artificial Sequence
  Representative cyclic modulating agent based on cadherin-14 cell adhesion recognition sequence
KFNIDANTGD

SEQ ID NO: 2017 - protein, 9 aa, Artificial Sequence
  Representative cyclic modulating agent based on cadherin-14 cell adhesion recognition sequence
KFFNIDAND

SEQ ID NO: 2018 - protein, 10 aa, Artificial Sequence
  Representative cyclic modulating agent based on cadherin-14 cell adhesion recognition sequence
KFFNIDANTD

SEQ ID NO: 2019 - protein, 11 aa, Artificial Sequence
  Representative cyclic modulating agent based on cadherin-14 cell adhesion recognition sequence
KFFNIDANTGD

SEQ ID NO: 2020 - protein, 5 aa, Artificial Sequence
  Representative cyclic modulating agent based on cadherin-14 cell adhesion recognition sequence
DDPKK

SEQ ID NO: 2021 - protein, 6 aa, Artificial Sequence
  Representative cyclic modulating agent based on cadherin-14 cell adhesion recognition sequence
DDPKTK

SEQ ID NO: 2022 - protein, 7 aa, Artificial Sequence
  Representative cyclic modulating agent based on cadherin-14 cell adhesion recognition sequence
DDPKTGK

SEQ ID NO: 2023 - protein, 6 aa, Artificial Sequence
  Representative cyclic modulating agent based on cadherin-14 cell adhesion recognition sequence
DVDPKK

SEQ ID NO: 2024 - protein, 7 aa, Artificial Sequence
  Representative cyclic modulating agent based on cadherin-14 cell adhesion recognition sequence
DVDPKTK

SEQ ID NO: 2025 - protein, 8 aa, Artificial Sequence
  Representative cyclic modulating agent based on cadherin-14 cell adhesion recognition sequence
DVDPKTGK

SEQ ID NO: 2026 - protein, 7 aa, Artificial Sequence
  Representative cyclic modulating agent based on cadherin-14 cell adhesion recognition sequence
DSVDPKK

SEQ ID NO: 2027 - protein, 8 aa, Artificial Sequence
  Representative cyclic modulating agent based on cadherin-14 cell adhesion recognition sequence
DSVDPKTK

SEQ ID NO: 2028 - protein, 9 aa, Artificial Sequence
  Representative cyclic modulating agent based on cadherin-14 cell adhesion recognition sequence
DSVDPKTGK

SEQ ID NO: 2029 - protein, 8 aa, Artificial Sequence
  Representative cyclic modulating agent based on cadherin-14 cell adhesion recognition sequence
DFSVDPKK

SEQ ID NO: 2030 - protein, 9 aa, Artificial Sequence
  Representative cyclic modulating agent based on cadherin-14 cell adhesion recognition sequence
DFSVDPKTK

SEQ ID NO: 2031 - protein, 10 aa, Artificial Sequence
  Representative cyclic modulating agent based on cadherin-14 cell adhesion recognition sequence
DFSVDPKTGK

SEQ ID NO: 2032 - protein, 9 aa, Artificial Sequence
  Representative cyclic modulating agent based on cadherin-14 cell adhesion recognition sequence
DYFSVDPKK

SEQ ID NO: 2033 - protein, 10 aa, Artificial Sequence
  Representative cyclic modulating agent based on cadherin-14 cell adhesion recognition sequence
DYFSVDPKTK

SEQ ID NO: 2034 - protein, 11 aa, Artificial Sequence
  Representative cyclic modulating agent based on cadherin-14 cell adhesion recognition sequence
DYFSVDPKTGK

SEQ ID NO: 2035 - protein, 5 aa, Artificial Sequence
  Representative cyclic modulating agent based on cadherin-14 cell adhesion recognition sequence
DDANK

SEQ ID NO: 2036 - protein, 6 aa, Artificial Sequence
  Representative cyclic modulating agent based on cadherin-14 cell adhesion recognition sequence
DDANTK

SEQ ID NO: 2037 - protein, 7 aa, Artificial Sequence
  Representative cyclic modulating agent based on cadherin-14 cell adhesion recognition sequence
DDANTGK

SEQ ID NO: 2038 - protein, 7 aa, Artificial Sequence
  Representative cyclic modulating agent based on cadherin-14 cell adhesion recognition sequence
DIDANTK

SEQ ID NO: 2039 - protein, 8 aa, Artificial Sequence
  Representative cyclic modulating agent based on cadherin-14 cell adhesion recognition sequence
DIDANTGK

SEQ ID NO: 2040 - protein, 8 aa, Artificial Sequence
  Representative cyclic modulating agent based on cadherin-14 cell adhesion recognition sequence
DNIDANTK

SEQ ID NO: 2041 - protein, 9 aa, Artificial Sequence
  Representative cyclic modulating agent based on cadherin-14 cell adhesion recognition sequence
DNIDANTGK

SEQ ID NO: 2042 - protein, 9 aa, Artificial Sequence
  Representative cyclic modulating agent based on cadherin-14 cell adhesion recognition sequence
DFNIDANTC

SEQ ID NO: 2043 - protein, 10 aa, Artificial Sequence
  Representative cyclic modulating agent based on cadherin-14 cell adhesion recognition sequence
DFNIDANTGK

SEQ ID NO: 2044 - protein, 9 aa, Artificial Sequence
  Representative cyclic modulating agent based on cadherin-14 cell adhesion recognition sequence
DFFNIDANK

SEQ ID NO: 2045 - protein, 10 aa, Artificial Sequence
  Representative cyclic modulating agent based on cadherin-14 cell adhesion recognition sequence
DFFNIDANTK

SEQ ID NO: 2046 - protein, 11 aa, Artificial Sequence
  Representative cyclic modulating agent based on cadherin-14 cell adhesion recognition sequence
DFFNIDANTGK

SEQ ID NO: 2047 - protein, 6 aa, Artificial Sequence
  Representative cyclic modulating agent based on cadherin-14 cell adhesion recognition sequence
KVDPKE

SEQ ID NO: 2048 - protein, 7 aa, Artificial Sequence
  Representative cyclic modulating agent based on cadherin-14 cell adhesion recognition sequence
KVDPKTE

SEQ ID NO: 2049 - protein, 8 aa, Artificial Sequence
  Representative cyclic modulating agent based on cadherin-14 cell adhesion recognition sequence
KVDPKTGE

SEQ ID NO: 2050 - protein, 7 aa, Artificial Sequence
  Representative cyclic modulating agent based on cadherin-14 cell adhesion recognition sequence
KSVDPKE

SEQ ID NO: 2051 - protein, 8 aa, Artificial Sequence
  Representative cyclic modulating agent based on cadherin-14 cell adhesion recognition sequence
KSVDPKTE

SEQ ID NO: 2052 - protein, 9 aa, Artificial Sequence
  Representative cyclic modulating agent based on cadherin-14 cell adhesion recognition sequence
KSVDPKTGE

SEQ ID NO: 2053 - protein, 8 aa, Artificial Sequence
  Representative cyclic modulating agent based on cadherin-14 cell adhesion recognition sequence
KFSVDPKE

SEQ ID NO: 2054 - protein, 9 aa, Artificial Sequence
  Representative cyclic modulating agent based on cadherin-14 cell adhesion recognition sequence
KFSVDPKTE

SEQ ID NO: 2055 - protein, 10 aa, Artificial Sequence
  Representative cyclic modulating agent based on cadherin-14 cell adhesion recognition sequence
KFSVDPKTGE

SEQ ID NO: 2056 - protein, 9 aa, Artificial Sequence
  Representative cyclic modulating agent based on cadherin-14 cell adhesion recognition sequence
KYFSVDPKE

SEQ ID NO: 2057 - protein, 10 aa, Artificial Sequence
  Representative cyclic modulating agent based on cadherin-14 cell adhesion recognition sequence
KYFSVDPKTE

SEQ ID NO: 2058 - protein, 11 aa, Artificial Sequence
  Representative cyclic modulating agent based on cadherin-14 cell adhesion recognition sequence
KYFSVDPKTGE

SEQ ID NO: 2059 - protein, 5 aa, Artificial Sequence
  Representative cyclic modulating agent based on cadherin-14 cell adhesion recognition sequence
KDANE

SEQ ID NO: 2060 - protein, 6 aa, Artificial Sequence
  Representative cyclic modulating agent based on cadherin-14 cell adhesion recognition sequence
KDANTE

SEQ ID NO: 2061 - protein, 7 aa, Artificial Sequence
  Representative cyclic modulating agent based on cadherin-14 cell adhesion recognition sequence
KDANTGE

SEQ ID NO: 2062 - protein, 7 aa, Artificial Sequence
  Representative cyclic modulating agent based on cadherin-14 cell adhesion recognition sequence
KIDANTE

SEQ ID NO: 2063 - protein, 8 aa, Artificial Sequence
  Representative cyclic modulating agent based on cadherin-14 cell adhesion recognition sequence
KIDANTGE

SEQ ID NO: 2064 - protein, 8 aa, Artificial Sequence
  Representative cyclic modulating agent based on cadherin-14 cell adhesion recognition sequence
KNIDANTE

SEQ ID NO: 2065 - protein, 9 aa, Artificial Sequence
  Representative cyclic modulating agent based on cadherin-14 cell adhesion recognition sequence
KNIDANTGE

SEQ ID NO: 2066 - protein, 9 aa, Artificial Sequence
  Representative cyclic modulating agent based on cadherin-14 cell adhesion recognition sequence
KFNIDANTE

SEQ ID NO: 2067 - protein, 10 aa, Artificial Sequence
  Representative cyclic modulating agent based on cadherin-14 cell adhesion recognition sequence
KFNIDANTGE

SEQ ID NO: 2068 - protein, 9 aa, Artificial Sequence
  Representative cyclic modulating agent based on cadherin-14 cell adhesion recognition sequence
KFFNIDANE

SEQ ID NO: 2069 - protein, 10 aa, Artificial Sequence
  Representative cyclic modulating agent based on cadherin-14 cell adhesion recognition sequence
KFFNIDANTE

SEQ ID NO: 2070 - protein, 11 aa, Artificial Sequence
  Representative cyclic modulating agent based on cadherin-14 cell adhesion recognition sequence
KFFNIDANTGE

SEQ ID NO: 2071 - protein, 5 aa, Artificial Sequence
  Representative cyclic modulating agent based on cadherin-14 cell adhesion recognition sequence
VDPKT

SEQ ID NO: 2072 - protein, 6 aa, Artificial Sequence
  Representative cyclic modulating agent based on cadherin-14 cell adhesion recognition sequence
VDPKTG

SEQ ID NO: 2073 - protein, 5 aa, Artificial Sequence
  Representative cyclic modulating agent based on cadherin-14 cell adhesion recognition sequence
SVDPK

SEQ ID NO: 2074 - protein, 6 aa, Artificial Sequence
  Representative cyclic modulating agent based on cadherin-14 cell adhesion recognition sequence
SVDPKT

SEQ ID NO: 2075 - protein, 7 aa, Artificial Sequence
  Representative cyclic modulating agent based on cadherin-14 cell adhesion recognition sequence
SVDPKTG

SEQ ID NO: 2076 - protein, 6 aa, Artificial Sequence
  Representative cyclic modulating agent based on cadherin-14 cell adhesion recognition sequence
FSVDPK

SEQ ID NO: 2077 - protein, 7 aa, Artificial Sequence
  Representative cyclic modulating agent based on cadherin-14 cell adhesion recognition sequence
FSVDPKT

SEQ ID NO: 2078 - protein, 8 aa, Artificial Sequence
  Representative cyclic modulating agent based on cadherin-14 cell adhesion recognition sequence
FSVDPKTG

SEQ ID NO: 2079 - protein, 7 aa, Artificial Sequence
  Representative cyclic modulating agent based on cadherin-14 cell adhesion recognition sequence
YFSVDPK

SEQ ID NO: 2080 - protein, 8 aa, Artificial Sequence
  Representative cyclic modulating agent based on cadherin-14 cell adhesion recognition sequence
YFSVDPKT

SEQ ID NO: 2081 - protein, 9 aa, Artificial Sequence
  Representative cyclic modulating agent based on cadherin-14 cell adhesion recognition sequence
YFSVDPKTG

SEQ ID NO: 2082 - protein, 5 aa, Artificial Sequence
  Representative cyclic modulating agent based on cadherin-14 cell adhesion recognition sequence
DANTG

SEQ ID NO: 2083 - protein, 5 aa, Artificial Sequence
  Representative cyclic modulating agent based on cadherin-14 cell adhesion recognition sequence
IDANT

SEQ ID NO: 2084 - protein, 6 aa, Artificial Sequence
  Representative cyclic modulating agent based on cadherin-14 cell adhesion recognition sequence
IDANTG

SEQ ID NO: 2085 - protein, 6 aa, Artificial Sequence
  Representative cyclic modulating agent based on cadherin-14 cell adhesion recognition sequence
NIDANT

SEQ ID NO: 2086 - protein, 7 aa, Artificial Sequence
  Representative cyclic modulating agent based on cadherin-14 cell adhesion recognition sequence
NIDANTG

SEQ ID NO: 2087 - protein, 7 aa, Artificial Sequence
  Representative cyclic modulating agent based on cadherin-14 cell adhesion recognition sequence
FNIDANT

SEQ ID NO: 2088 - protein, 8 aa, Artificial Sequence
  Representative cyclic modulating agent based on cadherin-14 cell adhesion recognition sequence
FNIDANTG

SEQ ID NO: 2089 - protein, 7 aa, Artificial Sequence
  Representative cyclic modulating agent based on cadherin-14 cell adhesion recognition sequence
FFNIDAN

SEQ ID NO: 2090 - protein, 8 aa, Artificial Sequence
  Representative cyclic modulating agent based on cadherin-14 cell adhesion recognition sequence
FFNIDANT

SEQ ID NO: 2091 - protein, 9 aa, Artificial Sequence
  Representative cyclic modulating agent based on cadherin-14 cell adhesion recognition sequence
FFNIDANTG

SEQ ID NO: 2092 - protein, 5 aa, Artificial Sequence
  Representative cyclic modulating agent based on cadherin-15 cell adhesion recognition sequence
CDKFC

SEQ ID NO: 2093 - protein, 6 aa, Artificial Sequence
  Representative cyclic modulating agent based on cadherin-15 cell adhesion recognition sequence
CIDKFC

SEQ ID NO: 2094 - protein, 6 aa, Artificial Sequence
  Representative cyclic modulating agent based on cadherin-15 cell adhesion recognition sequence
CDKFTC

SEQ ID NO: 2095 - protein, 7 aa, Artificial Sequence
  Representative cyclic modulating agent based on cadherin-15 cell adhesion recognition sequence
CSIDKFC

SEQ ID NO: 2096 - protein, 7 aa, Artificial Sequence
  Representative cyclic modulating agent based on cadherin-15 cell adhesion recognition sequence
CIDKFTC

SEQ ID NO: 2097 - protein, 8 aa, Artificial Sequence
  Representative cyclic modulating agent based on cadherin-15 cell adhesion recognition sequence
CSIDKFTC

SEQ ID NO: 2098 - protein, 7 aa, Artificial Sequence
  Representative cyclic modulating agent based on cadherin-15 cell adhesion recognition sequence
CDKFTGC

SEQ ID NO: 2099 - protein, 8 aa, Artificial Sequence
  Representative cyclic modulating agent based on cadherin-15 cell adhesion recognition sequence
CIDKFTGC

SEQ ID NO: 2100 - protein, 9 aa, Artificial Sequence
  Representative cyclic modulating agent based on cadherin-15 cell adhesion recognition sequence
CSIDKFTGC

SEQ ID NO: 2101 - protein, 8 aa, Artificial Sequence
  Representative cyclic modulating agent based on cadherin-15 cell adhesion recognition sequence
CFSIDKFC

SEQ ID NO: 2102 - protein, 9 aa, Artificial Sequence
  Representative cyclic modulating agent based on cadherin-15 cell adhesion recognition sequence
CFSIDKFTC

SEQ ID NO: 2103 - protein, 10 aa, Artificial Sequence
  Representative cyclic modulating agent based on cadherin-15 cell adhesion recognition sequence
CFSIDKFTGC

SEQ ID NO: 2104 - protein, 9 aa, Artificial Sequence
  Representative cyclic modulating agent based on cadherin-15 cell adhesion recognition sequence
CVFSIDKFC

SEQ ID NO: 2105 - protein, 10 aa, Artificial Sequence
  Representative cyclic modulating agent based on cadherin-15 cell adhesion recognition sequence
CVFSIDKFTC

SEQ ID NO: 2106 - protein, 11 aa, Artificial Sequence
  Representative cyclic modulating agent based on cadherin-15 cell adhesion recognition sequence
CVFSIDKFTGC

SEQ ID NO: 2107 - protein, 6 aa, Artificial Sequence
  Representative cyclic modulating agent based on cadherin-15 cell adhesion recognition sequence
DDKFTK

SEQ ID NO: 2108 - protein, 5 aa, Artificial Sequence
  Representative cyclic modulating agent based on cadherin-15 cell adhesion recognition sequence
DDKFK

SEQ ID NO: 2109 - protein, 6 aa, Artificial Sequence
  Representative cyclic modulating agent based on cadherin-15 cell adhesion recognition sequence
DIDKFK

SEQ ID NO: 2110 - protein, 7 aa, Artificial Sequence
  Representative cyclic modulating agent based on cadherin-15 cell adhesion recognition sequence
DSIDKFK

SEQ ID NO: 2111 - protein, 8 aa, Artificial Sequence
  Representative cyclic modulating agent based on cadherin-15 cell adhesion recognition sequence
DFSIDKFK

SEQ ID NO: 2112 - protein, 9 aa, Artificial Sequence
  Representative cyclic modulating agent based on cadherin-15 cell adhesion recognition sequence
DVFSIDKFK

SEQ ID NO: 2113 - protein, 5 aa, Artificial Sequence
  Representative cyclic modulating agent based on cadherin-15 cell adhesion recognition sequence
EDKFK

SEQ ID NO: 2114 - protein, 6 aa, Artificial Sequence
  Representative cyclic modulating agent based on cadherin-15 cell adhesion recognition sequence
EIDKFK

SEQ ID NO: 2115 - protein, 7 aa, Artificial Sequence
  Representative cyclic modulating agent based on cadherin-15 cell adhesion recognition sequence
ESIDKFK

SEQ ID NO: 2116 - protein, 8 aa, Artificial Sequence
  Representative cyclic modulating agent based on cadherin-15 cell adhesion recognition sequence
EFSIDKFK

SEQ ID NO: 2117 - protein, 9 aa, Artificial Sequence
  Representative cyclic modulating agent based on cadherin-15 cell adhesion recognition sequence
EVFSIDKFK

SEQ ID NO: 2118 - protein, 5 aa, Artificial Sequence
  Representative cyclic modulating agent based on cadherin-15 cell adhesion recognition sequence
KDKFD

SEQ ID NO: 2119 - protein, 6 aa, Artificial Sequence
  Representative cyclic modulating agent based on cadherin-15 cell adhesion recognition sequence
KIDKFD

SEQ ID NO: 2120 - protein, 6 aa, Artificial Sequence
  Representative cyclic modulating agent based on cadherin-15 cell adhesion recognition sequence
KDKFTD

SEQ ID NO: 2121 - protein, 7 aa, Artificial Sequence
  Representative cyclic modulating agent based on cadherin-15 cell adhesion recognition sequence
KSIDKFD

SEQ ID NO: 2122 - protein, 7 aa, Artificial Sequence
  Representative cyclic modulating agent based on cadherin-15 cell adhesion recognition sequence
KIDKFTD

SEQ ID NO: 2123 - protein, 8 aa, Artificial Sequence
  Representative cyclic modulating agent based on cadherin-15 cell adhesion recognition sequence
KSIDKFTD

SEQ ID NO: 2124 - protein, 7 aa, Artificial Sequence
  Representative cyclic modulating agent based on cadherin-15 cell adhesion recognition sequence
KDKFTGD

SEQ ID NO: 2125 - protein, 8 aa, Artificial Sequence
  Representative cyclic modulating agent based on cadherin-15 cell adhesion recognition sequence
KIDKFTGD

SEQ ID NO: 2126 - protein, 9 aa, Artificial Sequence
  Representative cyclic modulating agent based on cadherin-15 cell adhesion recognition sequence
KSIDKFTGD

SEQ ID NO: 2127 - protein, 8 aa, Artificial Sequence
  Representative cyclic modulating agent based on cadherin-15 cell adhesion recognition sequence
KFSIDKFD

SEQ ID NO: 2128 - protein, 9 aa, Artificial Sequence
  Representative cyclic modulating agent based on cadherin-15 cell adhesion recognition sequence
KFSIDKFTD

SEQ ID NO: 2129 - protein, 10 aa, Artificial Sequence
  Representative cyclic modulating agent based on cadherin-15 cell adhesion recognition sequence
KFSIDKFTGD

SEQ ID NO: 2130 - protein, 9 aa, Artificial Sequence
  Representative cyclic modulating agent based on cadherin-15 cell adhesion recognition sequence
KVFSIDKFD

SEQ ID NO: 2131 - protein, 10 aa, Artificial Sequence
  Representative cyclic modulating agent based on cadherin-15 cell adhesion recognition sequence
KVFSIDKFTD

SEQ ID NO: 2132 - protein, 11 aa, Artificial Sequence
  Representative cyclic modulating agent based on cadherin-15 cell adhesion recognition sequence
KVFSIDKFTGD

SEQ ID NO: 2133 - protein, 9 aa, Artificial Sequence
  Representative cyclic modulating agent based on cadherin-15 cell adhesion recognition sequence
DIDKFTHEK

SEQ ID NO: 2134 - protein, 5 aa, Artificial Sequence
  Representative cyclic modulating agent based on cadherin-15 cell adhesion recognition sequence
IDKFT

SEQ ID NO: 2135 - protein, 6 aa, Artificial Sequence
  Representative cyclic modulating agent based on cadherin-15 cell adhesion recognition sequence
SIDKFT

SEQ ID NO: 2136 - protein, 5 aa, Artificial Sequence
  Representative cyclic modulating agent based on cadherin-15 cell adhesion recognition sequence
DKFTG

SEQ ID NO: 2137 - protein, 6 aa, Artificial Sequence
  Representative cyclic modulating agent based on cadherin-15 cell adhesion recognition sequence
IDKFTG

SEQ ID NO: 2138 - protein, 5 aa, Artificial Sequence
  Representative cyclic modulating agent based on cadherin-15 cell adhesion recognition sequence
KDKFE

SEQ ID NO: 2139 - protein, 6 aa, Artificial Sequence
  Representative cyclic modulating agent based on cadherin-15 cell adhesion recognition sequence
KIDKFE

SEQ ID NO: 2140 - protein, 6 aa, Artificial Sequence
  Representative cyclic modulating agent based on cadherin-15 cell adhesion recognition sequence
KDKFTE

SEQ ID NO: 2141 - protein, 7 aa, Artificial Sequence
  Representative cyclic modulating agent based on cadherin-15 cell adhesion recognition sequence
KSIDKFE

SEQ ID NO: 2142 - protein, 7 aa, Artificial Sequence
  Representative cyclic modulating agent based on cadherin-15 cell adhesion recognition sequence
KIDKFTE

SEQ ID NO: 2143 - protein, 8 aa, Artificial Sequence
  Representative cyclic modulating agent based on cadherin-15 cell adhesion recognition sequence
KSIDKFTE

SEQ ID NO: 2144 - protein, 7 aa, Artificial Sequence
  Representative cyclic modulating agent based on cadherin-15 cell adhesion recognition sequence
KDKFTGE

SEQ ID NO: 2145 - protein, 8 aa, Artificial Sequence
  Representative cyclic modulating agent based on cadherin-15 cell adhesion recognition sequence
KIDKFTGE

SEQ ID NO: 2146 - protein, 9 aa, Artificial Sequence
  Representative cyclic modulating agent based on cadherin-15 cell adhesion recognition sequence
KSIDKFTGE

SEQ ID NO: 2147 - protein, 8 aa, Artificial Sequence
  Representative cyclic modulating agent based on cadherin-15 cell adhesion recognition sequence
KFSIDKFE

SEQ ID NO: 2148 - protein, 9 aa, Artificial Sequence
  Representative cyclic modulating agent based on cadherin-15 cell adhesion recognition sequence
KFSIDKFTE

SEQ ID NO: 2149 - protein, 10 aa, Artificial Sequence
  Representative cyclic modulating agent based on cadherin-15 cell adhesion recognition sequence
KFSIDKFTGE

SEQ ID NO: 2150 - protein, 9 aa, Artificial Sequence
  Representative cyclic modulating agent based on cadherin-15 cell adhesion recognition sequence
KVFSIDKFE

SEQ ID NO: 2151 - protein, 10 aa, Artificial Sequence
  Representative cyclic modulating agent based on cadherin-15 cell adhesion recognition sequence
KIFSIDKFTE

SEQ ID NO: 2152 - protein, 11 aa, Artificial Sequence
  Representative cyclic modulating agent based on cadherin-15 cell adhesion recognition sequence
KVFSIDKFTGE

SEQ ID NO: 2153 - protein, 5 aa, Artificial Sequence
  Representative cyclic modulating agent based on cadherin-15 cell adhesion recognition sequence
CDELC

SEQ ID NO: 2154 - protein, 6 aa, Artificial Sequence
  Representative cyclic modulating agent based on cadherin-15 cell adhesion recognition sequence
CDELTC

SEQ ID NO: 2155 - protein, 7 aa, Artificial Sequence
  Representative cyclic modulating agent based on cadherin-15 cell adhesion recognition sequence
CDELTGC

SEQ ID NO: 2156 - protein, 6 aa, Artificial Sequence
  Representative cyclic modulating agent based on cadherin-15 cell adhesion recognition sequence
CIDELC

SEQ ID NO: 2157 - protein, 7 aa, Artificial Sequence
  Representative cyclic modulating agent based on cadherin-15 cell adhesion recognition sequence
CIDELTC

SEQ ID NO: 2158 - protein, 8 aa, Artificial Sequence
  Representative cyclic modulating agent based on cadherin-15 cell adhesion recognition sequence
CIDELTGC

SEQ ID NO: 2159 - protein, 7 aa, Artificial Sequence
  Representative cyclic modulating agent based on cadherin-15 cell adhesion recognition sequence
CSIDELC

SEQ ID NO: 2160 - protein, 8 aa, Artificial Sequence
  Representative cyclic modulating agent based on cadherin-15 cell adhesion recognition sequence
CSIDELTC

SEQ ID NO: 2161 - protein, 9 aa, Artificial Sequence
  Representative cyclic modulating agent based on cadherin-15 cell adhesion recognition sequence
CSIDELTGC

SEQ ID NO: 2162 - protein, 8 aa, Artificial Sequence
  Representative cyclic modulating agent based on cadherin-15 cell adhesion recognition sequence
CFSIDELC

SEQ ID NO: 2163 - protein, 9 aa, Artificial Sequence
  Representative cyclic modulating agent based on cadherin-15 cell adhesion recognition sequence
CFSIDELTC

SEQ ID NO: 2164 - protein, 10 aa, Artificial Sequence
  Representative cyclic modulating agent based on cadherin-15 cell adhesion recognition sequence
CFSIDELTGC

SEQ ID NO: 2165 - protein, 9 aa, Artificial Sequence
  Representative cyclic modulating agent based on cadherin-15 cell adhesion recognition sequence
CLFSIDELC

SEQ ID NO: 2166 - protein, 10 aa, Artificial Sequence
  Representative cyclic modulating agent based on cadherin-15 cell adhesion recognition sequence
CLFSIDELTC

SEQ ID NO: 2167 - protein, 11 aa, Artificial Sequence
  Representative cyclic modulating agent based on cadherin-15 cell adhesion recognition sequence
CLFSIDELTGC

SEQ ID NO: 2168 - protein, 6 aa, Artificial Sequence
  Representative cyclic modulating agent based on cadherin-15 cell adhesion recognition sequence
EDELCK

SEQ ID NO: 2169 - protein, 6 aa, Artificial Sequence
  Representative cyclic modulating agent based on cadherin-15 cell adhesion recognition sequence
EDELTK

SEQ ID NO: 2170 - protein, 7 aa, Artificial Sequence
  Representative cyclic modulating agent based on cadherin-15 cell adhesion recognition sequence
EDELTGK

SEQ ID NO: 2171 - protein, 6 aa, Artificial Sequence
  Representative cyclic modulating agent based on cadherin-15 cell adhesion recognition sequence
EIDELK

SEQ ID NO: 2172 - protein, 7 aa, Artificial Sequence
  Representative cyclic modulating agent based on cadherin-15 cell adhesion recognition sequence
EIDELTK

SEQ ID NO: 2173 - protein, 8 aa, Artificial Sequence
  Representative cyclic modulating agent based on cadherin-15 cell adhesion recognition sequence
EIDELTGK

SEQ ID NO: 2174 - protein, 7 aa, Artificial Sequence
  Representative cyclic modulating agent based on cadherin-15 cell adhesion recognition sequence
ESIDELK

SEQ ID NO: 2175 - protein, 8 aa, Artificial Sequence
  Representative cyclic modulating agent based on cadherin-15 cell adhesion recognition sequence
ESIDELTK

SEQ ID NO: 2176 - protein, 9 aa, Artificial Sequence
  Representative cyclic modulating agent based on cadherin-15 cell adhesion recognition sequence
ESIDELTGK

SEQ ID NO: 2177 - protein, 8 aa, Artificial Sequence
  Representative cyclic modulating agent based on cadherin-15 cell adhesion recognition sequence
EFSIDELK

SEQ ID NO: 2178 - protein, 9 aa, Artificial Sequence
  Representative cyclic modulating agent based on cadherin-15 cell adhesion recognition sequence
EFSIDELTK

SEQ ID NO: 2179 - protein, 10 aa, Artificial Sequence
  Representative cyclic modulating agent based on cadherin-15 cell adhesion recognition sequence
EFSIDELTGK

SEQ ID NO: 2180 - protein, 9 aa, Artificial Sequence
  Representative cyclic modulating agent based on cadherin-15 cell adhesion recognition sequence
ELFSIDELK

SEQ ID NO: 2181 - protein, 10 aa, Artificial Sequence
  Representative cyclic modulating agent based on cadherin-15 cell adhesion recognition sequence
ELFSIDELTK

SEQ ID NO: 2182 - protein, 11 aa, Artificial Sequence
  Representative cyclic modulating agent based on cadherin-15 cell adhesion recognition sequence
ELFSIDELTGK

SEQ ID NO: 2183 - protein, 5 aa, Artificial Sequence
  Representative cyclic modulating agent based on cadherin-15 cell adhesion recognition sequence
KDELD

SEQ ID NO: 2184 - protein, 6 aa, Artificial Sequence
  Representative cyclic modulating agent based on cadherin-15 cell adhesion recognition sequence
KDELTD

SEQ ID NO: 2185 - protein, 7 aa, Artificial Sequence
  Representative cyclic modulating agent based on cadherin-15 cell adhesion recognition sequence
KDELTGD

SEQ ID NO: 2186 - protein, 6 aa, Artificial Sequence
  Representative cyclic modulating agent based on cadherin-15 cell adhesion recognition sequence
KIDELD

SEQ ID NO: 2187 - protein, 7 aa, Artificial Sequence
  Representative cyclic modulating agent based on cadherin-15 cell adhesion recognition sequence
KIDELTD

SEQ ID NO: 2188 - protein, 8 aa, Artificial Sequence
  Representative cyclic modulating agent based on cadherin-15 cell adhesion recognition sequence
KIDELTGD

SEQ ID NO: 2189 - protein, 7 aa, Artificial Sequence
  Representative cyclic modulating agent based on cadherin-15 cell adhesion recognition sequence
KSIDELD

SEQ ID NO: 2190 - protein, 8 aa, Artificial Sequence
  Representative cyclic modulating agent based on cadherin-15 cell adhesion recognition sequence
KSIDELTD

SEQ ID NO: 2191 - protein, 9 aa, Artificial Sequence
  Representative cyclic modulating agent based on cadherin-15 cell adhesion recognition sequence
KSIDELTGD

SEQ ID NO: 2192 - protein, 8 aa, Artificial Sequence
  Representative cyclic modulating agent based on cadherin-15 cell adhesion recognition sequence
KFSIDELD

SEQ ID NO: 2193 - protein, 9 aa, Artificial Sequence
  Representative cyclic modulating agent based on cadherin-15 cell adhesion recognition sequence
KFSIDELTD

SEQ ID NO: 2194 - protein, 10 aa, Artificial Sequence
  Representative cyclic modulating agent based on cadherin-15 cell adhesion recognition sequence
KFSIDELTGD

SEQ ID NO: 2195 - protein, 9 aa, Artificial Sequence
  Representative cyclic modulating agent based on cadherin-15 cell adhesion recognition sequence
KLFSIDELD

SEQ ID NO: 2196 - protein, 10 aa, Artificial Sequence
  Representative cyclic modulating agent based on cadherin-15 cell adhesion recognition sequence
KLFSIDELTD

SEQ ID NO: 2197 - protein, 11 aa, Artificial Sequence
  Representative cyclic modulating agent based on cadherin-15 cell adhesion recognition sequence
KLFSIDELTGD

SEQ ID NO: 2198 - protein, 5 aa, Artificial Sequence
  Representative cyclic modulating agent based on cadherin-15 cell adhesion recognition sequence
DDELK

SEQ ID NO: 2199 - protein, 6 aa, Artificial Sequence
  Representative cyclic modulating agent based on cadherin-15 cell adhesion recognition sequence
DDELTK

SEQ ID NO: 2200 - protein, 7 aa, Artificial Sequence
  Representative cyclic modulating agent based on cadherin-15 cell adhesion recognition sequence
DDELTGK

SEQ ID NO: 2201 - protein, 6 aa, Artificial Sequence
  Representative cyclic modulating agent based on cadherin-15 cell adhesion recognition sequence
DIDELK

SEQ ID NO: 2202 - protein, 7 aa, Artificial Sequence
  Representative cyclic modulating agent based on cadherin-15 cell adhesion recognition sequence
DIDELTK

SEQ ID NO: 2203 - protein, 8 aa, Artificial Sequence
  Representative cyclic modulating agent based on cadherin-15 cell adhesion recognition sequence
DIDELTGK

SEQ ID NO: 2204 - protein, 7 aa, Artificial Sequence
  Representative cyclic modulating agent based on cadherin-15 cell adhesion recognition sequence
DSIDELK

SEQ ID NO: 2205 - protein, 8 aa, Artificial Sequence
  Representative cyclic modulating agent based on cadherin-15 cell adhesion recognition sequence
DSIDELTK

SEQ ID NO: 2206 - protein, 9 aa, Artificial Sequence
  Representative cyclic modulating agent based on cadherin-15 cell adhesion recognition sequence
DSIDELTGK

SEQ ID NO: 2207 - protein, 8 aa, Artificial Sequence
  Representative cyclic modulating agent based on cadherin-15 cell adhesion recognition sequence
DFSIDELK

SEQ ID NO: 2208 - protein, 9 aa, Artificial Sequence
  Representative cyclic modulating agent based on cadherin-15 cell adhesion recognition sequence
DFSIDELTK

SEQ ID NO: 2209 - protein, 10 aa, Artificial Sequence
  Representative cyclic modulating agent based on cadherin-15 cell adhesion recognition sequence
DFSIDELTGK

SEQ ID NO: 2210 - protein, 9 aa, Artificial Sequence
  Representative cyclic modulating agent based on cadherin-15 cell adhesion recognition sequence
DLFSIDELK

SEQ ID NO: 2211 - protein, 10 aa, Artificial Sequence
  Representative cyclic modulating agent based on cadherin-15 cell adhesion recognition sequence
DLFSIDELTK

SEQ ID NO: 2212 - protein, 11 aa, Artificial Sequence
  Representative cyclic modulating agent based on cadherin-15 cell adhesion recognition sequence
DLFSIDELTGK

SEQ ID NO: 2213 - protein, 5 aa, Artificial Sequence
  Representative cyclic modulating agent based on cadherin-15 cell adhesion recognition sequence
KDELE

SEQ ID NO: 2214 - protein, 6 aa, Artificial Sequence
  Representative cyclic modulating agent based on cadherin-15 cell adhesion recognition sequence
KDELTE

SEQ ID NO: 2215 - protein, 7 aa, Artificial Sequence
  Representative cyclic modulating agent based on cadherin-15 cell adhesion recognition sequence
KDELTGE

SEQ ID NO: 2216 - protein, 6 aa, Artificial Sequence
  Representative cyclic modulating agent based on cadherin-15 cell adhesion recognition sequence
KIDELE

SEQ ID NO: 2217 - protein, 7 aa, Artificial Sequence
  Representative cyclic modulating agent based on cadherin-15 cell adhesion recognition sequence
KIDELTE

SEQ ID NO: 2218 - protein, 8 aa, Artificial Sequence
  Representative cyclic modulating agent based on cadherin-15 cell adhesion recognition sequence
KIDELTGE

SEQ ID NO: 2219 - protein, 7 aa, Artificial Sequence
  Representative cyclic modulating agent based on cadherin-15 cell adhesion recognition sequence
KSIDELE

SEQ ID NO: 2220 - protein, 8 aa, Artificial Sequence
  Representative cyclic modulating agent based on cadherin-15 cell adhesion recognition sequence
KSIDELTE

SEQ ID NO: 2221 - protein, 9 aa, Artificial Sequence
  Representative cyclic modulating agent based on cadherin-15 cell adhesion recognition sequence
KSIDELTGE

SEQ ID NO: 2222 - protein, 8 aa, Artificial Sequence
  Representative cyclic modulating agent based on cadherin-15 cell adhesion recognition sequence
KFSIDELE

SEQ ID NO: 2223 - protein, 9 aa, Artificial Sequence
  Representative cyclic modulating agent based on cadherin-15 cell adhesion recognition sequence
KFSIDELTE

SEQ ID NO: 2224 - protein, 10 aa, Artificial Sequence
  Representative cyclic modulating agent based on cadherin-15 cell adhesion recognition sequence
KFSIDELTGE

SEQ ID NO: 2225 - protein, 9 aa, Artificial Sequence
  Representative cyclic modulating agent based on cadherin-15 cell adhesion recognition sequence
KLFSIDELE

SEQ ID NO: 2226 - protein, 10 aa, Artificial Sequence
  Representative cyclic modulating agent based on cadherin-15 cell adhesion recognition sequence
KLFSIDELTE

SEQ ID NO: 2227 - protein, 11 aa, Artificial Sequence
  Representative cyclic modulating agent based on cadherin-15 cell adhesion recognition sequence
KLFSIDELTGE

SEQ ID NO: 2228 - protein, 5 aa, Artificial Sequence
  Representative cyclic modulating agent based on cadherin-15 cell adhesion recognition sequence
DELTG

SEQ ID NO: 2229 - protein, 5 aa, Artificial Sequence
  Representative cyclic modulating agent based on cadherin-15 cell adhesion recognition sequence
IDELT

SEQ ID NO: 2230 - protein, 6 aa, Artificial Sequence
  Representative cyclic modulating agent based on cadherin-15 cell adhesion recognition sequence
IDELTG

SEQ ID NO: 2231 - protein, 5 aa, Artificial Sequence
  Representative cyclic modulating agent based on cadherin-15 cell adhesion recognition sequence
SIDEL

SEQ ID NO: 2232 - protein, 6 aa, Artificial Sequence
  Representative cyclic modulating agent based on cadherin-15 cell adhesion recognition sequence
SIDELT

SEQ ID NO: 2233 - protein, 7 aa, Artificial Sequence
  Representative cyclic modulating agent based on cadherin-15 cell adhesion recognition sequence
SIDELTG

SEQ ID NO: 2234 - protein, 6 aa, Artificial Sequence
  Representative cyclic modulating agent based on cadherin-15 cell adhesion recognition sequence
FSIDEL

SEQ ID NO: 2235 - protein, 7 aa, Artificial Sequence
  Representative cyclic modulating agent based on cadherin-15 cell adhesion recognition sequence
FSIDELT

SEQ ID NO: 2236 - protein, 8 aa, Artificial Sequence
  Representative cyclic modulating agent based on cadherin-15 cell adhesion recognition sequence
FSIDELTG

SEQ ID NO: 2237 - protein, 7 aa, Artificial Sequence
  Representative cyclic modulating agent based on cadherin-15 cell adhesion recognition sequence
LFSIDEL

SEQ ID NO: 2238 - protein, 8 aa, Artificial Sequence
  Representative cyclic modulating agent based on cadherin-15 cell adhesion recognition sequence
LFSIDELT

SEQ ID NO: 2239 - protein, 9 aa, Artificial Sequence
  Representative cyclic modulating agent based on cadherin-15 cell adhesion recognition sequence
LFSIDELTG

SEQ ID NO: 2240 - protein, 5 aa, Artificial Sequence
  Representative cyclic modulating agent based on T-cadherin cell adhesion recognition sequence
CNENC

SEQ ID NO: 2241 - protein, 6 aa, Artificial Sequence
  Representative cyclic modulating agent based on T-cadherin cell adhesion recognition sequence
CINENC

SEQ ID NO: 2242 - protein, 6 aa, Artificial Sequence
  Representative cyclic modulating agent based on T-cadherin cell adhesion recognition sequence
CNENTC

SEQ ID NO: 2243 - protein, 7 aa, Artificial Sequence
  Representative cyclic modulating agent based on T-cadherin cell adhesion recognition sequence
CRINENC

SEQ ID NO: 2244 - protein, 7 aa, Artificial Sequence
  Representative cyclic modulating agent based on T-cadherin cell adhesion recognition sequence
CINENTC

SEQ ID NO: 2245 - protein, 8 aa, Artificial Sequence
  Representative cyclic modulating agent based on T-cadherin cell adhesion recognition sequence
CRINENTC

SEQ ID NO: 2246 - protein, 7 aa, Artificial Sequence
  Representative cyclic modulating agent based on T-cadherin cell adhesion recognition sequence
CNENTGC

SEQ ID NO: 2247 - protein, 8 aa, Artificial Sequence
  Representative cyclic modulating agent based on T-cadherin cell adhesion recognition sequence
CINENTGC

SEQ ID NO: 2248 - protein, 9 aa, Artificial Sequence
  Representative cyclic modulating agent based on T-cadherin cell adhesion recognition sequence
CRINENTGC

SEQ ID NO: 2249 - protein, 8 aa, Artificial Sequence
  Representative cyclic modulating agent based on T-cadherin cell adhesion recognition sequence
CFRINENC

SEQ ID NO: 2250 - protein, 9 aa, Artificial Sequence
  Representative cyclic modulating agent based on T-cadherin cell adhesion recognition sequence
CFRINENTC

SEQ ID NO: 2251 - protein, 10 aa, Artificial Sequence
  Representative cyclic modulating agent based on T-cadherin cell adhesion recognition sequence
CFRINENTGC

SEQ ID NO: 2252 - protein, 9 aa, Artificial Sequence
  Representative cyclic modulating agent based on T-cadherin cell adhesion recognition sequence
CIFRINENC

SEQ ID NO: 2253 - protein, 10 aa, Artificial Sequence
  Representative cyclic modulating agent based on T-cadherin cell adhesion recognition sequence
CIFRINENTC

SEQ ID NO: 2254 - protein, 11 aa, Artificial Sequence
  Representative cyclic modulating agent based on T-cadherin cell adhesion recognition sequence
CIFRINENTGC

SEQ ID NO: 2255 - protein, 5 aa, Artificial Sequence
  Representative cyclic modulating agent based on T-cadherin cell adhesion recognition sequence
DNENK

SEQ ID NO: 2256 - protein, 6 aa, Artificial Sequence
  Representative cyclic modulating agent based on T-cadherin cell adhesion recognition sequence
DINENK

SEQ ID NO: 2257 - protein, 7 aa, Artificial Sequence
  Representative cyclic modulating agent based on T-cadherin cell adhesion recognition sequence
DRINENK

SEQ ID NO: 2258 - protein, 8 aa, Artificial Sequence
  Representative cyclic modulating agent based on T-cadherin cell adhesion recognition sequence
DFRINENK

SEQ ID NO: 2259 - protein, 9 aa, Artificial Sequence
  Representative cyclic modulating agent based on T-cadherin cell adhesion recognition sequence
DIFRINENK

SEQ ID NO: 2260 - protein, 5 aa, Artificial Sequence
  Representative cyclic modulating agent based on T-cadherin cell adhesion recognition sequence
ENENK

SEQ ID NO: 2261 - protein, 6 aa, Artificial Sequence
  Representative cyclic modulating agent based on T-cadherin cell adhesion recognition sequence
EINENK

SEQ ID NO: 2262 - protein, 7 aa, Artificial Sequence
  Representative cyclic modulating agent based on T-cadherin cell adhesion recognition sequence
ERINENK

SEQ ID NO: 2263 - protein, 8 aa, Artificial Sequence
  Representative cyclic modulating agent based on T-cadherin cell adhesion recognition sequence
EFRINENK

SEQ ID NO: 2264 - protein, 9 aa, Artificial Sequence
  Representative cyclic modulating agent based on T-cadherin cell adhesion recognition sequence
EIFRINENK

SEQ ID NO: 2265 - protein, 5 aa, Artificial Sequence
  Representative cyclic modulating agent based on T-cadherin cell adhesion recognition sequence
KNEND

SEQ ID NO: 2266 - protein, 6 aa, Artificial Sequence
  Representative cyclic modulating agent based on T-cadherin cell adhesion recognition sequence
KINEND

SEQ ID NO: 2267 - protein, 6 aa, Artificial Sequence
  Representative cyclic modulating agent based on T-cadherin cell adhesion recognition sequence
KNENTD

SEQ ID NO: 2268 - protein, 7 aa, Artificial Sequence
  Representative cyclic modulating agent based on T-cadherin cell adhesion recognition sequence
KRINEND

SEQ ID NO: 2269 - protein, 7 aa, Artificial Sequence
  Representative cyclic modulating agent based on T-cadherin cell adhesion recognition sequence
KINENTD

SEQ ID NO: 2270 - protein, 8 aa, Artificial Sequence
  Representative cyclic modulating agent based on T-cadherin cell adhesion recognition sequence
KRINENTD

SEQ ID NO: 2271 - protein, 7 aa, Artificial Sequence
  Representative cyclic modulating agent based on T-cadherin cell adhesion recognition sequence
KNENTGD

SEQ ID NO: 2272 - protein, 8 aa, Artificial Sequence
  Representative cyclic modulating agent based on T-cadherin cell adhesion recognition sequence
KINENTGD

SEQ ID NO: 2273 - protein, 9 aa, Artificial Sequence
  Representative cyclic modulating agent based on T-cadherin cell adhesion recognition sequence
KRINENTGD

SEQ ID NO: 2274 - protein, 8 aa, Artificial Sequence
  Representative cyclic modulating agent based on T-cadherin cell adhesion recognition sequence
KFRINEND

SEQ ID NO: 2275 - protein, 9 aa, Artificial Sequence
  Representative cyclic modulating agent based on T-cadherin cell adhesion recognition sequence
KFRINENTD

SEQ ID NO: 2276 - protein, 10 aa, Artificial Sequence
  Representative cyclic modulating agent based on T-cadherin cell adhesion recognition sequence
KFRINENTGD

SEQ ID NO: 2277 - protein, 9 aa, Artificial Sequence
  Representative cyclic modulating agent based on T-cadherin cell adhesion recognition sequence
KIFRINEND

SEQ ID NO: 2278 - protein, 10 aa, Artificial Sequence
  Representative cyclic modulating agent based on T-cadherin cell adhesion recognition sequence
KIFRINENTD

SEQ ID NO: 2279 - protein, 11 aa, Artificial Sequence
  Representative cyclic modulating agent based on T-cadherin cell adhesion recognition sequence
KIFRINENTGD

SEQ ID NO: 2280 - protein, 5 aa, Artificial Sequence
  Representative cyclic modulating agent based on T-cadherin cell adhesion recognition sequence
VNENT

SEQ ID NO: 2281 - protein, 5 aa, Artificial Sequence
  Representative cyclic modulating agent based on T-cadherin cell adhesion recognition sequence
INENT

SEQ ID NO: 2282 - protein, 6 aa, Artificial Sequence
  Representative cyclic modulating agent based on T-cadherin cell adhesion recognition sequence
RINENT

SEQ ID NO: 2283 - protein, 5 aa, Artificial Sequence
  Representative cyclic modulating agent based on T-cadherin cell adhesion recognition sequence
NENTG

SEQ ID NO: 2284 - protein, 6 aa, Artificial Sequence
  Representative cyclic modulating agent based on T-cadherin cell adhesion recognition sequence
INENTG

SEQ ID NO: 2285 - protein, 5 aa, Artificial Sequence
  Representative cyclic modulating agent based on T-cadherin cell adhesion recognition sequence
KNENE

SEQ ID NO: 2286 - protein, 6 aa, Artificial Sequence
  Representative cyclic modulating agent based on T-cadherin cell adhesion recognition sequence
KINENE

SEQ ID NO: 2287 - protein, 6 aa, Artificial Sequence
  Representative cyclic modulating agent based on T-cadherin cell adhesion recognition sequence
KNENTE

SEQ ID NO: 2288 - protein, 7 aa, Artificial Sequence
  Representative cyclic modulating agent based on T-cadherin cell adhesion recognition sequence
KRINENE

SEQ ID NO: 2289 - protein, 7 aa, Artificial Sequence
  Representative cyclic modulating agent based on T-cadherin cell adhesion recognition sequence
KINENTE

SEQ ID NO: 2290 - protein, 8 aa, Artificial Sequence
  Representative cyclic modulating agent based on T-cadherin cell adhesion recognition sequence
KRINENTE

SEQ ID NO: 2291 - protein, 7 aa, Artificial Sequence
  Representative cyclic modulating agent based on T-cadherin cell adhesion recognition sequence
KNENTGE

SEQ ID NO: 2292 - protein, 8 aa, Artificial Sequence
  Representative cyclic modulating agent based on T-cadherin cell adhesion recognition sequence
KINENTGE

SEQ ID NO: 2293 - protein, 9 aa, Artificial Sequence
  Representative cyclic modulating agent based on T-cadherin cell adhesion recognition sequence
KRINENTGE

SEQ ID NO: 2294 - protein, 8 aa, Artificial Sequence
  Representative cyclic modulating agent based on T-cadherin cell adhesion recognition sequence
KFRINENE

SEQ ID NO: 2295 - protein, 9 aa, Artificial Sequence
  Representative cyclic modulating agent based on T-cadherin cell adhesion recognition sequence
KFRINENTE

SEQ ID NO: 2296 - protein, 10 aa, Artificial Sequence
  Representative cyclic modulating agent based on T-cadherin cell adhesion recognition sequence
KFRINENTGE

SEQ ID NO: 2297 - protein, 9 aa, Artificial Sequence
  Representative cyclic modulating agent based on T-cadherin cell adhesion recognition sequence
KIFRINENE

SEQ ID NO: 2298 - protein, 10 aa, Artificial Sequence
  Representative cyclic modulating agent based on T-cadherin cell adhesion recognition sequence
KIFRINENTE

SEQ ID NO: 2299 - protein, 11 aa, Artificial Sequence
  Representative cyclic modulating agent based on T-cadherin cell adhesion recognition sequence
KIFRINENTGE

SEQ ID NO: 2300 - protein, 5 aa, Artificial Sequence
  Representative cyclic modulating agent based on PB-cadherin cell adhesion recognition sequence
CEEYC

SEQ ID NO: 2301 - protein, 6 aa, Artificial Sequence
  Representative cyclic modulating agent based on PB-cadherin cell adhesion recognition sequence
CEEYTC

SEQ ID NO: 2302 - protein, 6 aa, Artificial Sequence
  Representative cyclic modulating agent based on PB-cadherin cell adhesion recognition sequence
CEEYTG

SEQ ID NO: 2303 - protein, 6 aa, Artificial Sequence
  Representative cyclic modulating agent based on PB-cadherin cell adhesion recognition sequence
CVEEYC

SEQ ID NO: 2304 - protein, 7 aa, Artificial Sequence
  Representative cyclic modulating agent based on PB-cadherin cell adhesion recognition sequence
CVEEYTC

SEQ ID NO: 2305 - protein, 8 aa, Artificial Sequence
  Representative cyclic modulating agent based on PB-cadherin cell adhesion recognition sequence
CVEEYTGC

SEQ ID NO: 2306 - protein, 7 aa, Artificial Sequence
  Representative cyclic modulating agent based on PB-cadherin cell adhesion recognition sequence
CVVEEYC

SEQ ID NO: 2307 - protein, 8 aa, Artificial Sequence
  Representative cyclic modulating agent based on PB-cadherin cell adhesion recognition sequence
CVVEEYTC

SEQ ID NO: 2308 - protein, 9 aa, Artificial Sequence
  Representative cyclic modulating agent based on PB-cadherin cell adhesion recognition sequence
CVVEEYTGC

SEQ ID NO: 2309 - protein, 8 aa, Artificial Sequence
  Representative cyclic modulating agent based on PB-cadherin cell adhesion recognition sequence
CFVVEEYC

SEQ ID NO: 2310 - protein, 8 aa, Artificial Sequence
  Representative cyclic modulating agent based on PB-cadherin cell adhesion recognition sequence
CFVEEYTC

SEQ ID NO: 2311 - protein, 9 aa, Artificial Sequence
  Representative cyclic modulating agent based on PB-cadherin cell adhesion recognition sequence
CFVEEYTGC

SEQ ID NO: 2312 - protein, 9 aa, Artificial Sequence
  Representative cyclic modulating agent based on PB-cadherin cell adhesion recognition sequence
CFFVVEEYC

SEQ ID NO: 2313 - protein, 10 aa, Artificial Sequence
  Representative cyclic modulating agent based on PB-cadherin cell adhesion recognition sequence
CFFVVEEYTC

SEQ ID NO: 2314 - protein, 11 aa, Artificial Sequence
  Representative cyclic modulating agent based on PB-cadherin cell adhesion recognition sequence
CFFVVEEYTGC

SEQ ID NO: 2315 - protein, 7 aa, Artificial Sequence
  Representative cyclic modulating agent based on PB-cadherin cell adhesion recognition sequence
CLIDELC

SEQ ID NO: 2316 - protein, 8 aa, Artificial Sequence
  Representative cyclic modulating agent based on PB-cadherin cell adhesion recognition sequence
CLIDELTC

SEQ ID NO: 2317 - protein, 9 aa, Artificial Sequence
  Representative cyclic modulating agent based on PB-cadherin cell adhesion recognition sequence
CLIDELTGC

SEQ ID NO: 2318 - protein, 8 aa, Artificial Sequence
  Representative cyclic modulating agent based on PB-cadherin cell adhesion recognition sequence
CFLIDELC

SEQ ID NO: 2319 - protein, 9 aa, Artificial Sequence
  Representative cyclic modulating agent based on PB-cadherin cell adhesion recognition sequence
CFLIDELTC

SEQ ID NO: 2320 - protein, 10 aa, Artificial Sequence
  Representative cyclic modulating agent based on PB-cadherin cell adhesion recognition sequence
CFLIDELTGC

SEQ ID NO: 2321 - protein, 9 aa, Artificial Sequence
  Representative cyclic modulating agent based on PB-cadherin cell adhesion recognition sequence
CIFLIDELC

SEQ ID NO: 2322 - protein, 10 aa, Artificial Sequence
  Representative cyclic modulating agent based on PB-cadherin cell adhesion recognition sequence
CIFLIDELTC

SEQ ID NO: 2323 - protein, 11 aa, Artificial Sequence
  Representative cyclic modulating agent based on PB-cadherin cell adhesion recognition sequence
CIFLIDELTGC

SEQ ID NO: 2324 - protein, 7 aa, Artificial Sequence
  Representative cyclic modulating agent based on PB-cadherin cell adhesion recognition sequence
CTVDPKC

SEQ ID NO: 2325 - protein, 8 aa, Artificial Sequence
  Representative cyclic modulating agent based on PB-cadherin cell adhesion recognition sequence
CTVDPKTC

SEQ ID NO: 2326 - protein, 9 aa, Artificial Sequence
  Representative cyclic modulating agent based on PB-cadherin cell adhesion recognition sequence
CTVDPKTGC

SEQ ID NO: 2327 - protein, 8 aa, Artificial Sequence
  Representative cyclic modulating agent based on PB-cadherin cell adhesion recognition sequence
CFTVDPKC

SEQ ID NO: 2328 - protein, 9 aa, Artificial Sequence
  Representative cyclic modulating agent based on PB-cadherin cell adhesion recognition sequence
CFTVDPKTC

SEQ ID NO: 2329 - protein, 10 aa, Artificial Sequence
  Representative cyclic modulating agent based on PB-cadherin cell adhesion recognition sequence
CFTVDPKTGC

SEQ ID NO: 2330 - protein, 9 aa, Artificial Sequence
  Representative cyclic modulating agent based on PB-cadherin cell adhesion recognition sequence
CHFTVDPKC

SEQ ID NO: 2331 - protein, 10 aa, Artificial Sequence
  Representative cyclic modulating agent based on PB-cadherin cell adhesion recognition sequence
CHFTVDPKTC

SEQ ID NO: 2332 - protein, 11 aa, Artificial Sequence
  Representative cyclic modulating agent based on PB-cadherin cell adhesion recognition sequence
CHFTVDPKTGC

SEQ ID NO: 2333 - protein, 5 aa, Artificial Sequence
  Representative cyclic modulating agent based on PB-cadherin cell adhesion recognition sequence
CDADC

SEQ ID NO: 2334 - protein, 6 aa, Artificial Sequence
  Representative cyclic modulating agent based on PB-cadherin cell adhesion recognition sequence
CDADTC

SEQ ID NO: 2335 - protein, 7 aa, Artificial Sequence
  Representative cyclic modulating agent based on PB-cadherin cell adhesion recognition sequence
CDADTGC

SEQ ID NO: 2336 - protein, 6 aa, Artificial Sequence
  Representative cyclic modulating agent based on PB-cadherin cell adhesion recognition sequence
CIDADC

SEQ ID NO: 2337 - protein, 7 aa, Artificial Sequence
  Representative cyclic modulating agent based on PB-cadherin cell adhesion recognition sequence
CIDADTC

SEQ ID NO: 2338 - protein, 8 aa, Artificial Sequence
  Representative cyclic modulating agent based on PB-cadherin cell adhesion recognition sequence
CIDADTGC

SEQ ID NO: 2339 - protein, 7 aa, Artificial Sequence
  Representative cyclic modulating agent based on PB-cadherin cell adhesion recognition sequence
CDIDADC

SEQ ID NO: 2340 - protein, 8 aa, Artificial Sequence
  Representative cyclic modulating agent based on PB-cadherin cell adhesion recognition sequence
CDIDADTC

SEQ ID NO: 2341 - protein, 9 aa, Artificial Sequence
  Representative cyclic modulating agent based on PB-cadherin cell adhesion recognition sequence
CDIDADTGC

SEQ ID NO: 2342 - protein, 8 aa, Artificial Sequence
  Representative cyclic modulating agent based on PB-cadherin cell adhesion recognition sequence
CFDIDADC

SEQ ID NO: 2343 - protein, 9 aa, Artificial Sequence
  Representative cyclic modulating agent based on PB-cadherin cell adhesion recognition sequence
CFDIDADTC

SEQ ID NO: 2344 - protein, 10 aa, Artificial Sequence
  Representative cyclic modulating agent based on PB-cadherin cell adhesion recognition sequence
CFDIDADTGC

SEQ ID NO: 2345 - protein, 9 aa, Artificial Sequence
  Representative cyclic modulating agent based on PB-cadherin cell adhesion recognition sequence
CIFDIDADC

SEQ ID NO: 2346 - protein, 10 aa, Artificial Sequence
  Representative cyclic modulating agent based on PB-cadherin cell adhesion recognition sequence
CIFDIDADTC

SEQ ID NO: 2347 - protein, 11 aa, Artificial Sequence
  Representative cyclic modulating agent based on PB-cadherin cell adhesion recognition sequence
CIFDIDADTGC

SEQ ID NO: 2348 - protein, 5 aa, Artificial Sequence
  Representative cyclic modulating agent based on PB-cadherin cell adhesion recognition sequence
EEEYK

SEQ ID NO: 2349 - protein, 6 aa, Artificial Sequence
  Representative cyclic modulating agent based on PB-cadherin cell adhesion recognition sequence
EEEYTK

SEQ ID NO: 2350 - protein, 7 aa, Artificial Sequence
  Representative cyclic modulating agent based on PB-cadherin cell adhesion recognition sequence
EEEYTGK

SEQ ID NO: 2351 - protein, 6 aa, Artificial Sequence
  Representative cyclic modulating agent based on PB-cadherin cell adhesion recognition sequence
EVEEYK

SEQ ID NO: 2352 - protein, 7 aa, Artificial Sequence
  Representative cyclic modulating agent based on PB-cadherin cell adhesion recognition sequence
EVEEYTK

SEQ ID NO: 2353 - protein, 8 aa, Artificial Sequence
  Representative cyclic modulating agent based on PB-cadherin cell adhesion recognition sequence
EVEEYTGK

SEQ ID NO: 2354 - protein, 7 aa, Artificial Sequence
  Representative cyclic modulating agent based on PB-cadherin cell adhesion recognition sequence
EVVEEYK

SEQ ID NO: 2355 - protein, 8 aa, Artificial Sequence
  Representative cyclic modulating agent based on PB-cadherin cell adhesion recognition sequence
EVVEEYTK

SEQ ID NO: 2356 - protein, 9 aa, Artificial Sequence
  Representative cyclic modulating agent based on PB-cadherin cell adhesion recognition sequence
EVVEEYTGK

SEQ ID NO: 2357 - protein, 8 aa, Artificial Sequence
  Representative cyclic modulating agent based on PB-cadherin cell adhesion recognition sequence
EFVVEEYK

SEQ ID NO: 2358 - protein, 8 aa, Artificial Sequence
  Representative cyclic modulating agent based on PB-cadherin cell adhesion recognition sequence
EFVEEYTK

SEQ ID NO: 2359 - protein, 9 aa, Artificial Sequence
  Representative cyclic modulating agent based on PB-cadherin cell adhesion recognition sequence
EFVEEYTGK

SEQ ID NO: 2360 - protein, 9 aa, Artificial Sequence
  Representative cyclic modulating agent based on PB-cadherin cell adhesion recognition sequence
EFFVVEEYK

SEQ ID NO: 2361 - protein, 10 aa, Artificial Sequence
  Representative cyclic modulating agent based on PB-cadherin cell adhesion recognition sequence
EFFVVEEYTK

SEQ ID NO: 2362 - protein, 11 aa, Artificial Sequence
  Representative cyclic modulating agent based on PB-cadherin cell adhesion recognition sequence
EFFVVEEYTGK

SEQ ID NO: 2363 - protein, 5 aa, Artificial Sequence
  Representative cyclic modulating agent based on PB-cadherin cell adhesion recognition sequence
EDELK

SEQ ID NO: 2364 - protein, 6 aa, Artificial Sequence
  Representative cyclic modulating agent based on PB-cadherin cell adhesion recognition sequence
EDELTK

SEQ ID NO: 2365 - protein, 7 aa, Artificial Sequence
  Representative cyclic modulating agent based on PB-cadherin cell adhesion recognition sequence
EDELTGK

SEQ ID NO: 2366 - protein, 6 aa, Artificial Sequence
  Representative cyclic modulating agent based on PB-cadherin cell adhesion recognition sequence
EIDELK

SEQ ID NO: 2367 - protein, 7 aa, Artificial Sequence
  Representative cyclic modulating agent based on PB-cadherin cell adhesion recognition sequence
EIDELTK

SEQ ID NO: 2368 - protein, 8 aa, Artificial Sequence
  Representative cyclic modulating agent based on PB-cadherin cell adhesion recognition sequence
EIDELTGK

SEQ ID NO: 2369 - protein, 7 aa, Artificial Sequence
  Representative cyclic modulating agent based on PB-cadherin cell adhesion recognition sequence
ELIDELK

SEQ ID NO: 2370 - protein, 8 aa, Artificial Sequence
  Representative cyclic modulating agent based on PB-cadherin cell adhesion recognition sequence
ELIDELTK

SEQ ID NO: 2371 - protein, 9 aa, Artificial Sequence
  Representative cyclic modulating agent based on PB-cadherin cell adhesion recognition sequence
ELIDELTGK

SEQ ID NO: 2372 - protein, 8 aa, Artificial Sequence
  Representative cyclic modulating agent based on PB-cadherin cell adhesion recognition sequence
EFLIDELK

SEQ ID NO: 2373 - protein, 9 aa, Artificial Sequence
  Representative cyclic modulating agent based on PB-cadherin cell adhesion recognition sequence
EFLIDELTK

SEQ ID NO: 2374 - protein, 10 aa, Artificial Sequence
  Representative cyclic modulating agent based on PB-cadherin cell adhesion recognition sequence
EFLIDELTGK

SEQ ID NO: 2375 - protein, 9 aa, Artificial Sequence
  Representative cyclic modulating agent based on PB-cadherin cell adhesion recognition sequence
EIFLIDELK

SEQ ID NO: 2376 - protein, 10 aa, Artificial Sequence
  Representative cyclic modulating agent based on PB-cadherin cell adhesion recognition sequence
EIFLIDELTK

SEQ ID NO: 2377 - protein, 11 aa, Artificial Sequence
  Representative cyclic modulating agent based on PB-cadherin cell adhesion recognition sequence
EIFLIDELTGK

SEQ ID NO: 2378 - protein, 5 aa, Artificial Sequence
  Representative cyclic modulating agent based on PB-cadherin cell adhesion recognition sequence
EDPKK

SEQ ID NO: 2379 - protein, 6 aa, Artificial Sequence
  Representative cyclic modulating agent based on PB-cadherin cell adhesion recognition sequence
EDPKTK

SEQ ID NO: 2380 - protein, 7 aa, Artificial Sequence
  Representative cyclic modulating agent based on PB-cadherin cell adhesion recognition sequence
EDPKTGK

SEQ ID NO: 2381 - protein, 6 aa, Artificial Sequence
  Representative cyclic modulating agent based on PB-cadherin cell adhesion recognition sequence
EVDPKK

SEQ ID NO: 2382 - protein, 7 aa, Artificial Sequence
  Representative cyclic modulating agent based on PB-cadherin cell adhesion recognition sequence
EVDPKTK

SEQ ID NO: 2383 - protein, 8 aa, Artificial Sequence
  Representative cyclic modulating agent based on PB-cadherin cell adhesion recognition sequence
EVDPKTGK

SEQ ID NO: 2384 - protein, 7 aa, Artificial Sequence
  Representative cyclic modulating agent based on PB-cadherin cell adhesion recognition sequence
ETVDPKK

SEQ ID NO: 2385 - protein, 8 aa, Artificial Sequence
  Representative cyclic modulating agent based on PB-cadherin cell adhesion recognition sequence
ETVDPKTK

SEQ ID NO: 2386 - protein, 9 aa, Artificial Sequence
  Representative cyclic modulating agent based on PB-cadherin cell adhesion recognition sequence
ETVDPKTGK

SEQ ID NO: 2387 - protein, 8 aa, Artificial Sequence
  Representative cyclic modulating agent based on PB-cadherin cell adhesion recognition sequence
EFTVDPKK

SEQ ID NO: 2388 - protein, 9 aa, Artificial Sequence
  Representative cyclic modulating agent based on PB-cadherin cell adhesion recognition sequence
EFTVDPKTK

SEQ ID NO: 2389 - protein, 10 aa, Artificial Sequence
  Representative cyclic modulating agent based on PB-cadherin cell adhesion recognition sequence
EFTVDPKTGK

SEQ ID NO: 2390 - protein, 9 aa, Artificial Sequence
  Representative cyclic modulating agent based on PB-cadherin cell adhesion recognition sequence
EHFTVDPKK

SEQ ID NO: 2391 - protein, 10 aa, Artificial Sequence
  Representative cyclic modulating agent based on PB-cadherin cell adhesion recognition sequence
EHFTVDPKTK

SEQ ID NO: 2392 - protein, 11 aa, Artificial Sequence
  Representative cyclic modulating agent based on PB-cadherin cell adhesion recognition sequence
EHFTVDPKTGK

SEQ ID NO: 2393 - protein, 5 aa, Artificial Sequence
  Representative cyclic modulating agent based on PB-cadherin cell adhesion recognition sequence
EDADK

SEQ ID NO: 2394 - protein, 6 aa, Artificial Sequence
  Representative cyclic modulating agent based on PB-cadherin cell adhesion recognition sequence
EDADTK

SEQ ID NO: 2395 - protein, 7 aa, Artificial Sequence
  Representative cyclic modulating agent based on PB-cadherin cell adhesion recognition sequence
EDADTGK

SEQ ID NO: 2396 - protein, 6 aa, Artificial Sequence
  Representative cyclic modulating agent based on PB-cadherin cell adhesion recognition sequence
EIDADK

SEQ ID NO: 2397 - protein, 7 aa, Artificial Sequence
  Representative cyclic modulating agent based on PB-cadherin cell adhesion recognition sequence
EIDADTK

SEQ ID NO: 2398 - protein, 8 aa, Artificial Sequence
  Representative cyclic modulating agent based on PB-cadherin cell adhesion recognition sequence
EIDADTGK

SEQ ID NO: 2399 - protein, 7 aa, Artificial Sequence
  Representative cyclic modulating agent based on PB-cadherin cell adhesion recognition sequence
EDIDADK

SEQ ID NO: 2400 - protein, 8 aa, Artificial Sequence
  Representative cyclic modulating agent based on PB-cadherin cell adhesion recognition sequence
EDIDADTK

SEQ ID NO: 2401 - protein, 9 aa, Artificial Sequence
  Representative cyclic modulating agent based on PB-cadherin cell adhesion recognition sequence
EDIDADTGK

SEQ ID NO: 2402 - protein, 8 aa, Artificial Sequence
  Representative cyclic modulating agent based on PB-cadherin cell adhesion recognition sequence
EFDIDADK

SEQ ID NO: 2403 - protein, 9 aa, Artificial Sequence
  Representative cyclic modulating agent based on PB-cadherin cell adhesion recognition sequence
EFDIDADTK

SEQ ID NO: 2404 - protein, 10 aa, Artificial Sequence
  Representative cyclic modulating agent based on PB-cadherin cell adhesion recognition sequence
EFDIDADTGK

SEQ ID NO: 2405 - protein, 9 aa, Artificial Sequence
  Representative cyclic modulating agent based on PB-cadherin cell adhesion recognition sequence
EIFDIDADK

SEQ ID NO: 2406 - protein, 10 aa, Artificial Sequence
  Representative cyclic modulating agent based on PB-cadherin cell adhesion recognition sequence
EIFDIDADTK

SEQ ID NO: 2407 - protein, 11 aa, Artificial Sequence
  Representative cyclic modulating agent based on PB-cadherin cell adhesion recognition sequence
EIFDIDADTGK

SEQ ID NO: 2408 - protein, 5 aa, Artificial Sequence
  Representative cyclic modulating agent based on PB-cadherin cell adhesion recognition sequence
KEEYD

SEQ ID NO: 2409 - protein, 6 aa, Artificial Sequence
  Representative cyclic modulating agent based on PB-cadherin cell adhesion recognition sequence
KEEYTD

SEQ ID NO: 2410 - protein, 7 aa, Artificial Sequence
  Representative cyclic modulating agent based on PB-cadherin cell adhesion recognition sequence
KEEYTGD

SEQ ID NO: 2411 - protein, 6 aa, Artificial Sequence
  Representative cyclic modulating agent based on PB-cadherin cell adhesion recognition sequence
KVEEYD

SEQ ID NO: 2412 - protein, 7 aa, Artificial Sequence
  Representative cyclic modulating agent based on PB-cadherin cell adhesion recognition sequence
KVEEYTD

SEQ ID NO: 2413 - protein, 8 aa, Artificial Sequence
  Representative cyclic modulating agent based on PB-cadherin cell adhesion recognition sequence
KVEEYTGD

SEQ ID NO: 2414 - protein, 7 aa, Artificial Sequence
  Representative cyclic modulating agent based on PB-cadherin cell adhesion recognition sequence
KVVEEYD

SEQ ID NO: 2415 - protein, 8 aa, Artificial Sequence
  Representative cyclic modulating agent based on PB-cadherin cell adhesion recognition sequence
KVVEEYTD

SEQ ID NO: 2416 - protein, 9 aa, Artificial Sequence
  Representative cyclic modulating agent based on PB-cadherin cell adhesion recognition sequence
KVVEEYTGD

SEQ ID NO: 2417 - protein, 8 aa, Artificial Sequence
  Representative cyclic modulating agent based on PB-cadherin cell adhesion recognition sequence
KFVVEEYD

SEQ ID NO: 2418 - protein, 8 aa, Artificial Sequence
  Representative cyclic modulating agent based on PB-cadherin cell adhesion recognition sequence
KFVEEYTD

SEQ ID NO: 2419 - protein, 9 aa, Artificial Sequence
  Representative cyclic modulating agent based on PB-cadherin cell adhesion recognition sequence
KFVEEYTGD

SEQ ID NO: 2420 - protein, 9 aa, Artificial Sequence
  Representative cyclic modulating agent based on PB-cadherin cell adhesion recognition sequence
KFFVVEEYD

SEQ ID NO: 2421 - protein, 10 aa, Artificial Sequence
  Representative cyclic modulating agent based on PB-cadherin cell adhesion recognition sequence
KFFVVEEYTD

SEQ ID NO: 2422 - protein, 11 aa, Artificial Sequence
  Representative cyclic modulating agent based on PB-cadherin cell adhesion recognition sequence
KFFVVEEYTGD

SEQ ID NO: 2423 - protein, 5 aa, Artificial Sequence
  Representative cyclic modulating agent based on PB-cadherin cell adhesion recognition sequence
KDELD

SEQ ID NO: 2424 - protein, 6 aa, Artificial Sequence
  Representative cyclic modulating agent based on PB-cadherin cell adhesion recognition sequence
KDELTD

SEQ ID NO: 2425 - protein, 7 aa, Artificial Sequence
  Representative cyclic modulating agent based on PB-cadherin cell adhesion recognition sequence
KDELTGD

SEQ ID NO: 2426 - protein, 6 aa, Artificial Sequence
  Representative cyclic modulating agent based on PB-cadherin cell adhesion recognition sequence
KIDELD

SEQ ID NO: 2427 - protein, 7 aa, Artificial Sequence
  Representative cyclic modulating agent based on PB-cadherin cell adhesion recognition sequence
KIDELTD

SEQ ID NO: 2428 - protein, 8 aa, Artificial Sequence
  Representative cyclic modulating agent based on PB-cadherin cell adhesion recognition sequence
KIDELTGD

SEQ ID NO: 2429 - protein, 7 aa, Artificial Sequence
  Representative cyclic modulating agent based on PB-cadherin cell adhesion recognition sequence
KLIDELD

SEQ ID NO: 2430 - protein, 8 aa, Artificial Sequence
  Representative cyclic modulating agent based on PB-cadherin cell adhesion recognition sequence
KLIDELTD

SEQ ID NO: 2431 - protein, 9 aa, Artificial Sequence
  Representative cyclic modulating agent based on PB-cadherin cell adhesion recognition sequence
KLIDELTGD

SEQ ID NO: 2432 - protein, 8 aa, Artificial Sequence
  Representative cyclic modulating agent based on PB-cadherin cell adhesion recognition sequence
KFLIDELD

SEQ ID NO: 2433 - protein, 9 aa, Artificial Sequence
  Representative cyclic modulating agent based on PB-cadherin cell adhesion recognition sequence
KFLIDELTD

SEQ ID NO: 2434 - protein, 10 aa, Artificial Sequence
  Representative cyclic modulating agent based on PB-cadherin cell adhesion recognition sequence
KFLIDELTGD

SEQ ID NO: 2435 - protein, 9 aa, Artificial Sequence
  Representative cyclic modulating agent based on PB-cadherin cell adhesion recognition sequence
KIFLIDELD

SEQ ID NO: 2436 - protein, 10 aa, Artificial Sequence
  Representative cyclic modulating agent based on PB-cadherin cell adhesion recognition sequence
KIFLIDELTD

SEQ ID NO: 2437 - protein, 11 aa, Artificial Sequence
  Representative cyclic modulating agent based on PB-cadherin cell adhesion recognition sequence
KIFLIDELTGD

SEQ ID NO: 2438 - protein, 5 aa, Artificial Sequence
  Representative cyclic modulating agent based on PB-cadherin cell adhesion recognition sequence
KDPKD

SEQ ID NO: 2439 - protein, 6 aa, Artificial Sequence
  Representative cyclic modulating agent based on PB-cadherin cell adhesion recognition sequence
KDPKTD

SEQ ID NO: 2440 - protein, 7 aa, Artificial Sequence
  Representative cyclic modulating agent based on PB-cadherin cell adhesion recognition sequence
KDPKTGD

SEQ ID NO: 2441 - protein, 6 aa, Artificial Sequence
  Representative cyclic modulating agent based on PB-cadherin cell adhesion recognition sequence
KVDPKD

SEQ ID NO: 2442 - protein, 7 aa, Artificial Sequence
  Representative cyclic modulating agent based on PB-cadherin cell adhesion recognition sequence
KVDPKTD

SEQ ID NO: 2443 - protein, 8 aa, Artificial Sequence
  Representative cyclic modulating agent based on PB-cadherin cell adhesion recognition sequence
KVDPKTGD

SEQ ID NO: 2444 - protein, 7 aa, Artificial Sequence
  Representative cyclic modulating agent based on PB-cadherin cell adhesion recognition sequence
KTVDPKD

SEQ ID NO: 2445 - protein, 8 aa, Artificial Sequence
  Representative cyclic modulating agent based on PB-cadherin cell adhesion recognition sequence
KTVDPKTD

SEQ ID NO: 2446 - protein, 9 aa, Artificial Sequence
  Representative cyclic modulating agent based on PB-cadherin cell adhesion recognition sequence
KTVDPKTGD

SEQ ID NO: 2447 - protein, 8 aa, Artificial Sequence
  Representative cyclic modulating agent based on PB-cadherin cell adhesion recognition sequence
KFTVDPKD

SEQ ID NO: 2448 - protein, 9 aa, Artificial Sequence
  Representative cyclic modulating agent based on PB-cadherin cell adhesion recognition sequence
KFTVDPKTD

SEQ ID NO: 2449 - protein, 10 aa, Artificial Sequence
  Representative cyclic modulating agent based on PB-cadherin cell adhesion recognition sequence
KFTVDPKTGD

SEQ ID NO: 2450 - protein, 9 aa, Artificial Sequence
  Representative cyclic modulating agent based on PB-cadherin cell adhesion recognition sequence
KHFTVDPKD

SEQ ID NO: 2451 - protein, 10 aa, Artificial Sequence
  Representative cyclic modulating agent based on PB-cadherin cell adhesion recognition sequence
KHFTVDPKTD

SEQ ID NO: 2452 - protein, 11 aa, Artificial Sequence
  Representative cyclic modulating agent based on PB-cadherin cell adhesion recognition sequence
KHFTVDPKTGD

SEQ ID NO: 2453 - protein, 5 aa, Artificial Sequence
  Representative cyclic modulating agent based on PB-cadherin cell adhesion recognition sequence
KDADD

SEQ ID NO: 2454 - protein, 6 aa, Artificial Sequence
  Representative cyclic modulating agent based on PB-cadherin cell adhesion recognition sequence
KDADTD

SEQ ID NO: 2455 - protein, 7 aa, Artificial Sequence
  Representative cyclic modulating agent based on PB-cadherin cell adhesion recognition sequence
KDADTGD

SEQ ID NO: 2456 - protein, 6 aa, Artificial Sequence
  Representative cyclic modulating agent based on PB-cadherin cell adhesion recognition sequence
KIDADD

SEQ ID NO: 2457 - protein, 7 aa, Artificial Sequence
  Representative cyclic modulating agent based on PB-cadherin cell adhesion recognition sequence
KIDADTD

SEQ ID NO: 2458 - protein, 8 aa, Artificial Sequence
  Representative cyclic modulating agent based on PB-cadherin cell adhesion recognition sequence
KIDADTGD

SEQ ID NO: 2459 - protein, 7 aa, Artificial Sequence
  Representative cyclic modulating agent based on PB-cadherin cell adhesion recognition sequence
KDIDADD

SEQ ID NO: 2460 - protein, 8 aa, Artificial Sequence
  Representative cyclic modulating agent based on PB-cadherin cell adhesion recognition sequence
KDIDADTD

SEQ ID NO: 2461 - protein, 9 aa, Artificial Sequence
  Representative cyclic modulating agent based on PB-cadherin cell adhesion recognition sequence
KDIDADTGD

SEQ ID NO: 2462 - protein, 8 aa, Artificial Sequence
  Representative cyclic modulating agent based on PB-cadherin cell adhesion recognition sequence
KFDIDADD

SEQ ID NO: 2463 - protein, 9 aa, Artificial Sequence
  Representative cyclic modulating agent based on PB-cadherin cell adhesion recognition sequence
KFDIDADTD

SEQ ID NO: 2464 - protein, 10 aa, Artificial Sequence
  Representative cyclic modulating agent based on PB-cadherin cell adhesion recognition sequence
KFDIDADTGD

SEQ ID NO: 2465 - protein, 9 aa, Artificial Sequence
  Representative cyclic modulating agent based on PB-cadherin cell adhesion recognition sequence
KIFDIDADD

SEQ ID NO: 2466 - protein, 10 aa, Artificial Sequence
  Representative cyclic modulating agent based on PB-cadherin cell adhesion recognition sequence
KIFDIDADTD

SEQ ID NO: 2467 - protein, 11 aa, Artificial Sequence
  Representative cyclic modulating agent based on PB-cadherin cell adhesion recognition sequence
KIFDIDADTGD

SEQ ID NO: 2468 - protein, 5 aa, Artificial Sequence
  Representative cyclic modulating agent based on PB-cadherin cell adhesion recognition sequence
DEEYK

SEQ ID NO: 2469 - protein, 6 aa, Artificial Sequence
  Representative cyclic modulating agent based on PB-cadherin cell adhesion recognition sequence
DEEYTK

SEQ ID NO: 2470 - protein, 7 aa, Artificial Sequence
  Representative cyclic modulating agent based on PB-cadherin cell adhesion recognition sequence
DEEYTGK

SEQ ID NO: 2471 - protein, 6 aa, Artificial Sequence
  Representative cyclic modulating agent based on PB-cadherin cell adhesion recognition sequence
DVEEYK

SEQ ID NO: 2472 - protein, 7 aa, Artificial Sequence
  Representative cyclic modulating agent based on PB-cadherin cell adhesion recognition sequence
DVEEYTK

SEQ ID NO: 2473 - protein, 8 aa, Artificial Sequence
  Representative cyclic modulating agent based on PB-cadherin cell adhesion recognition sequence
DVEEYTGK

SEQ ID NO: 2474 - protein, 7 aa, Artificial Sequence
  Representative cyclic modulating agent based on PB-cadherin cell adhesion recognition sequence
DVVEEYK

SEQ ID NO: 2475 - protein, 8 aa, Artificial Sequence
  Representative cyclic modulating agent based on PB-cadherin cell adhesion recognition sequence
DVVEEYTK

SEQ ID NO: 2476 - protein, 9 aa, Artificial Sequence
  Representative cyclic modulating agent based on PB-cadherin cell adhesion recognition sequence
DVVEEYTGK

SEQ ID NO: 2477 - protein, 8 aa, Artificial Sequence
  Representative cyclic modulating agent based on PB-cadherin cell adhesion recognition sequence
DFVVEEYK

SEQ ID NO: 2478 - protein, 8 aa, Artificial Sequence
  Representative cyclic modulating agent based on PB-cadherin cell adhesion recognition sequence
DFVEEYTK

SEQ ID NO: 2479 - protein, 9 aa, Artificial Sequence
  Representative cyclic modulating agent based on PB-cadherin cell adhesion recognition sequence
DFVEEYTGK

SEQ ID NO: 2480 - protein, 9 aa, Artificial Sequence
  Representative cyclic modulating agent based on PB-cadherin cell adhesion recognition sequence
DFFVVEEYK

SEQ ID NO: 2481 - protein, 10 aa, Artificial Sequence
  Representative cyclic modulating agent based on PB-cadherin cell adhesion recognition sequence
DFFVVEEYTK

SEQ ID NO: 2482 - protein, 11 aa, Artificial Sequence
  Representative cyclic modulating agent based on PB-cadherin cell adhesion recognition sequence
DFFVVEEYTGK

SEQ ID NO: 2483 - protein, 5 aa, Artificial Sequence
  Representative cyclic modulating agent based on PB-cadherin cell adhesion recognition sequence
DDELK

SEQ ID NO: 2484 - protein, 6 aa, Artificial Sequence
  Representative cyclic modulating agent based on PB-cadherin cell adhesion recognition sequence
DDELTK

SEQ ID NO: 2485 - protein, 7 aa, Artificial Sequence
  Representative cyclic modulating agent based on PB-cadherin cell adhesion recognition sequence
DDELTGK

SEQ ID NO: 2486 - protein, 6 aa, Artificial Sequence
  Representative cyclic modulating agent based on PB-cadherin cell adhesion recognition sequence
DIDELK

SEQ ID NO: 2487 - protein, 7 aa, Artificial Sequence
  Representative cyclic modulating agent based on PB-cadherin cell adhesion recognition sequence
DIDELTK

SEQ ID NO: 2488 - protein, 8 aa, Artificial Sequence
  Representative cyclic modulating agent based on PB-cadherin cell adhesion recognition sequence
DIDELTGK

SEQ ID NO: 2489 - protein, 7 aa, Artificial Sequence
  Representative cyclic modulating agent based on PB-cadherin cell adhesion recognition sequence
DLIDELK

SEQ ID NO: 2490 - protein, 8 aa, Artificial Sequence
  Representative cyclic modulating agent based on PB-cadherin cell adhesion recognition sequence
DLIDELTK

SEQ ID NO: 2491 - protein, 9 aa, Artificial Sequence
  Representative cyclic modulating agent based on PB-cadherin cell adhesion recognition sequence
DLIDELTGK

SEQ ID NO: 2492 - protein, 8 aa, Artificial Sequence
  Representative cyclic modulating agent based on PB-cadherin cell adhesion recognition sequence
DFLIDELK

SEQ ID NO: 2493 - protein, 9 aa, Artificial Sequence
  Representative cyclic modulating agent based on PB-cadherin cell adhesion recognition sequence
DFLIDELTK

SEQ ID NO: 2494 - protein, 10 aa, Artificial Sequence
  Representative cyclic modulating agent based on PB-cadherin cell adhesion recognition sequence
DFLIDELTGK

SEQ ID NO: 2495 - protein, 9 aa, Artificial Sequence
  Representative cyclic modulating agent based on PB-cadherin cell adhesion recognition sequence
DIFLIDELK

SEQ ID NO: 2496 - protein, 10 aa, Artificial Sequence
  Representative cyclic modulating agent based on PB-cadherin cell adhesion recognition sequence
DIFLIDELTK

SEQ ID NO: 2497 - protein, 11 aa, Artificial Sequence
  Representative cyclic modulating agent based on PB-cadherin cell adhesion recognition sequence
DIFLIDELTGK

SEQ ID NO: 2498 - protein, 5 aa, Artificial Sequence
  Representative cyclic modulating agent based on PB-cadherin cell adhesion recognition sequence
DDPKK

SEQ ID NO: 2499 - protein, 6 aa, Artificial Sequence
  Representative cyclic modulating agent based on PB-cadherin cell adhesion recognition sequence
DDPKTK

SEQ ID NO: 2500 - protein, 7 aa, Artificial Sequence
  Representative cyclic modulating agent based on PB-cadherin cell adhesion recognition sequence
DDPKTGK

SEQ ID NO: 2501 - protein, 6 aa, Artificial Sequence
  Representative cyclic modulating agent based on PB-cadherin cell adhesion recognition sequence
DVDPKK

SEQ ID NO: 2502 - protein, 7 aa, Artificial Sequence
  Representative cyclic modulating agent based on PB-cadherin cell adhesion recognition sequence
DVDPKYK

SEQ ID NO: 2503 - protein, 8 aa, Artificial Sequence
  Representative cyclic modulating agent based on PB-cadherin cell adhesion recognition sequence
DVTPKTGK

SEQ ID NO: 2504 - protein, 7 aa, Artificial Sequence
  Representative cyclic modulating agent based on PB-cadherin cell adhesion recognition sequence
DTVDPKK

SEQ ID NO: 2505 - protein, 8 aa, Artificial Sequence
  Representative cyclic modulating agent based on PB-cadherin cell adhesion recognition sequence
DTVDPKTK

SEQ ID NO: 2506 - protein, 9 aa, Artificial Sequence
  Representative cyclic modulating agent based on PB-cadherin cell adhesion recognition sequence
DTVDPKTGK

SEQ ID NO: 2507 - protein, 8 aa, Artificial Sequence
  Representative cyclic modulating agent based on PB-cadherin cell adhesion recognition sequence
DFTVDPKK

SEQ ID NO: 2508 - protein, 9 aa, Artificial Sequence
  Representative cyclic modulating agent based on PB-cadherin cell adhesion recognition sequence
DFTVDPKTK

SEQ ID NO: 2509 - protein, 10 aa, Artificial Sequence
  Representative cyclic modulating agent based on PB-cadherin cell adhesion recognition sequence
DFTVDPKTGK

SEQ ID NO: 2510 - protein, 9 aa, Artificial Sequence
  Representative cyclic modulating agent based on PB-cadherin cell adhesion recognition sequence
DHFTVDPKK

SEQ ID NO: 2511 - protein, 10 aa, Artificial Sequence
  Representative cyclic modulating agent based on PB-cadherin cell adhesion recognition sequence
DHFTVDPKTK

SEQ ID NO: 2512 - protein, 11 aa, Artificial Sequence
  Representative cyclic modulating agent based on PB-cadherin cell adhesion recognition sequence
DHFTVDPKTGK

SEQ ID NO: 2513 - protein, 5 aa, Artificial Sequence
  Representative cyclic modulating agent based on PB-cadherin cell adhesion recognition sequence
DDADK

SEQ ID NO: 2514 - protein, 6 aa, Artificial Sequence
  Representative cyclic modulating agent based on PB-cadherin cell adhesion recognition sequence
DDADTK

SEQ ID NO: 2515 - protein, 7 aa, Artificial Sequence
  Representative cyclic modulating agent based on PB-cadherin cell adhesion recognition sequence
DDADTGK

SEQ ID NO: 2516 - protein, 6 aa, Artificial Sequence
  Representative cyclic modulating agent based on PB-cadherin cell adhesion recognition sequence
DIDADK

SEQ ID NO: 2517 - protein, 7 aa, Artificial Sequence
  Representative cyclic modulating agent based on PB-cadherin cell adhesion recognition sequence
DIDADTK

SEQ ID NO: 2518 - protein, 8 aa, Artificial Sequence
  Representative cyclic modulating agent based on PB-cadherin cell adhesion recognition sequence
DIDADTGK

SEQ ID NO: 2519 - protein, 7 aa, Artificial Sequence
  Representative cyclic modulating agent based on PB-cadherin cell adhesion recognition sequence
DDIDADK

SEQ ID NO: 2520 - protein, 8 aa, Artificial Sequence
  Representative cyclic modulating agent based on PB-cadherin cell adhesion recognition sequence
DDIDADTK

SEQ ID NO: 2521 - protein, 9 aa, Artificial Sequence
  Representative cyclic modulating agent based on PB-cadherin cell adhesion recognition sequence
DDIDADTGK

SEQ ID NO: 2522 - protein, 8 aa, Artificial Sequence
  Representative cyclic modulating agent based on PB-cadherin cell adhesion recognition sequence
DFDIDADK

SEQ ID NO: 2523 - protein, 9 aa, Artificial Sequence
  Representative cyclic modulating agent based on PB-cadherin cell adhesion recognition sequence
DFDIDADTK

SEQ ID NO: 2524 - protein, 10 aa, Artificial Sequence
  Representative cyclic modulating agent based on PB-cadherin cell adhesion recognition sequence
DFDIDADTGK

SEQ ID NO: 2525 - protein, 9 aa, Artificial Sequence
  Representative cyclic modulating agent based on PB-cadherin cell adhesion recognition sequence
DIFDIDADK

SEQ ID NO: 2526 - protein, 10 aa, Artificial Sequence
  Representative cyclic modulating agent based on PB-cadherin cell adhesion recognition sequence
DIFDIDADTK

SEQ ID NO: 2527 - protein, 11 aa, Artificial Sequence
  Representative cyclic modulating agent based on PB-cadherin cell adhesion recognition sequence
DIFDIDADTGK

SEQ ID NO: 2528 - protein, 5 aa, Artificial Sequence
  Representative cyclic modulating agent based on PB-cadherin cell adhesion recognition sequence
KEEYE

SEQ ID NO: 2529 - protein, 6 aa, Artificial Sequence
  Representative cyclic modulating agent based on PB-cadherin cell adhesion recognition sequence
KEEYTE

SEQ ID NO: 2530 - protein, 7 aa, Artificial Sequence
  Representative cyclic modulating agent based on PB-cadherin cell adhesion recognition sequence
KEEYTGE

SEQ ID NO: 2531 - protein, 6 aa, Artificial Sequence
  Representative cyclic modulating agent based on PB-cadherin cell adhesion recognition sequence
KVEEYE

SEQ ID NO: 2532 - protein, 7 aa, Artificial Sequence
  Representative cyclic modulating agent based on PB-cadherin cell adhesion recognition sequence
KVEEYTE

SEQ ID NO: 2533 - protein, 8 aa, Artificial Sequence
  Representative cyclic modulating agent based on PB-cadherin cell adhesion recognition sequence
KVEEYTGE

SEQ ID NO: 2534 - protein, 7 aa, Artificial Sequence
  Representative cyclic modulating agent based on PB-cadherin cell adhesion recognition sequence
KVVEEYE

SEQ ID NO: 2535 - protein, 8 aa, Artificial Sequence
  Representative cyclic modulating agent based on PB-cadherin cell adhesion recognition sequence
KVVEEYTE

SEQ ID NO: 2536 - protein, 9 aa, Artificial Sequence
  Representative cyclic modulating agent based on PB-cadherin cell adhesion recognition sequence
KVVEEYTGE

SEQ ID NO: 2537 - protein, 8 aa, Artificial Sequence
  Representative cyclic modulating agent based on PB-cadherin cell adhesion recognition sequence
KFVVEEYE

SEQ ID NO: 2538 - protein, 8 aa, Artificial Sequence
  Representative cyclic modulating agent based on PB-cadherin cell adhesion recognition sequence
KFVEEYTE

SEQ ID NO: 2539 - protein, 9 aa, Artificial Sequence
  Representative cyclic modulating agent based on PB-cadherin cell adhesion recognition sequence
KFVEEYTGE

SEQ ID NO: 2540 - protein, 9 aa, Artificial Sequence
  Representative cyclic modulating agent based on PB-cadherin cell adhesion recognition sequence
KFFVVEEYE

SEQ ID NO: 2541 - protein, 10 aa, Artificial Sequence
  Representative cyclic modulating agent based on PB-cadherin cell adhesion recognition sequence
KFFVVEEYTE

SEQ ID NO: 2542 - protein, 11 aa, Artificial Sequence
  Representative cyclic modulating agent based on PB-cadherin cell adhesion recognition sequence
KFFVVEEYTGE

SEQ ID NO: 2543 - protein, 5 aa, Artificial Sequence
  Representative cyclic modulating agent based on PB-cadherin cell adhesion recognition sequence
KDELE

SEQ ID NO: 2544 - protein, 6 aa, Artificial Sequence
  Representative cyclic modulating agent based on PB-cadherin cell adhesion recognition sequence
KDELTE

SEQ ID NO: 2545 - protein, 7 aa, Artificial Sequence
  Representative cyclic modulating agent based on PB-cadherin cell adhesion recognition sequence
KDELTGE

SEQ ID NO: 2546 - protein, 6 aa, Artificial Sequence
  Representative cyclic modulating agent based on PB-cadherin cell adhesion recognition sequence
KIDELE

SEQ ID NO: 2547 - protein, 7 aa, Artificial Sequence
  Representative cyclic modulating agent based on PB-cadherin cell adhesion recognition sequence
KIDELTE

SEQ ID NO: 2548 - protein, 8 aa, Artificial Sequence
  Representative cyclic modulating agent based on PB-cadherin cell adhesion recognition sequence
KIDELTGE

SEQ ID NO: 2549 - protein, 7 aa, Artificial Sequence
  Representative cyclic modulating agent based on PB-cadherin cell adhesion recognition sequence
KLIDELE

SEQ ID NO: 2550 - protein, 8 aa, Artificial Sequence
  Representative cyclic modulating agent based on PB-cadherin cell adhesion recognition sequence
KLIDELTE

SEQ ID NO: 2551 - protein, 9 aa, Artificial Sequence
  Representative cyclic modulating agent based on PB-cadherin cell adhesion recognition sequence
KLIDELTGE

SEQ ID NO: 2552 - protein, 8 aa, Artificial Sequence
  Representative cyclic modulating agent based on PB-cadherin cell adhesion recognition sequence
KFLIDELE

SEQ ID NO: 2553 - protein, 9 aa, Artificial Sequence
  Representative cyclic modulating agent based on PB-cadherin cell adhesion recognition sequence
KFLIDELTE

SEQ ID NO: 2554 - protein, 10 aa, Artificial Sequence
  Representative cyclic modulating agent based on PB-cadherin cell adhesion recognition sequence
KFLIDELTGE

SEQ ID NO: 2555 - protein, 9 aa, Artificial Sequence
  Representative cyclic modulating agent based on PB-cadherin cell adhesion recognition sequence
KIFLIDELE

SEQ ID NO: 2556 - protein, 10 aa, Artificial Sequence
  Representative cyclic modulating agent based on PB-cadherin cell adhesion recognition sequence
KIFLIDELTE

SEQ ID NO: 2557 - protein, 11 aa, Artificial Sequence
  Representative cyclic modulating agent based on PB-cadherin cell adhesion recognition sequence
KIFLIDELTGE

SEQ ID NO: 2558 - protein, 5 aa, Artificial Sequence
  Representative cyclic modulating agent based on PB-cadherin cell adhesion recognition sequence
KDPKE

SEQ ID NO: 2559 - protein, 6 aa, Artificial Sequence
  Representative cyclic modulating agent based on PB-cadherin cell adhesion recognition sequence
KDPKTE

SEQ ID NO: 2560 - protein, 7 aa, Artificial Sequence
  Representative cyclic modulating agent based on PB-cadherin cell adhesion recognition sequence
KDPKTGE

SEQ ID NO: 2561 - protein, 6 aa, Artificial Sequence
  Representative cyclic modulating agent based on PB-cadherin cell adhesion recognition sequence
KVDPKE

SEQ ID NO: 2562 - protein, 7 aa, Artificial Sequence
  Representative cyclic modulating agent based on PB-cadherin cell adhesion recognition sequence
KVDPKTE

SEQ ID NO: 2563 - protein, 7 aa, Artificial Sequence
  Representative cyclic modulating agent based on PB-cadherin cell adhesion recognition sequence
KDPKTGE

SEQ ID NO: 2564 - protein, 7 aa, Artificial Sequence
  Representative cyclic modulating agent based on PB-cadherin cell adhesion recognition sequence
KTVDPKE

SEQ ID NO: 2565 - protein, 8 aa, Artificial Sequence
  Representative cyclic modulating agent based on PB-cadherin cell adhesion recognition sequence
KTVDPKTE

SEQ ID NO: 2566 - protein, 9 aa, Artificial Sequence
  Representative cyclic modulating agent based on PB-cadherin cell adhesion recognition sequence
KTVDPKTGE

SEQ ID NO: 2567 - protein, 8 aa, Artificial Sequence
  Representative cyclic modulating agent based on PB-cadherin cell adhesion recognition sequence
KFTVDPKE

SEQ ID NO: 2568 - protein, 9 aa, Artificial Sequence
  Representative cyclic modulating agent based on PB-cadherin cell adhesion recognition sequence
KFTVDPKTE

SEQ ID NO: 2569 - protein, 10 aa, Artificial Sequence
  Representative cyclic modulating agent based on PB-cadherin cell adhesion recognition sequence
KFTVDPKTGE

SEQ ID NO: 2570 - protein, 9 aa, Artificial Sequence
  Representative cyclic modulating agent based on PB-cadherin cell adhesion recognition sequence
KHFTVDPKE

SEQ ID NO: 2571 - protein, 10 aa, Artificial Sequence
  Representative cyclic modulating agent based on PB-cadherin cell adhesion recognition sequence
KHFTVDPKTE

SEQ ID NO: 2572 - protein, 11 aa, Artificial Sequence
  Representative cyclic modulating agent based on PB-cadherin cell adhesion recognition sequence
KHFTVDPKTGE

SEQ ID NO: 2573 - protein, 5 aa, Artificial Sequence
  Representative cyclic modulating agent based on PB-cadherin cell adhesion recognition sequence
KDADE

SEQ ID NO: 2574 - protein, 6 aa, Artificial Sequence
  Representative cyclic modulating agent based on PB-cadherin cell adhesion recognition sequence
KDADTE

SEQ ID NO: 2575 - protein, 7 aa, Artificial Sequence
  Representative cyclic modulating agent based on PB-cadherin cell adhesion recognition sequence
KDADTGE

SEQ ID NO: 2576 - protein, 6 aa, Artificial Sequence
  Representative cyclic modulating agent based on PB-cadherin cell adhesion recognition sequence
KIDADE

SEQ ID NO: 2577 - protein, 7 aa, Artificial Sequence
  Representative cyclic modulating agent based on PB-cadherin cell adhesion recognition sequence
KIDADTE

SEQ ID NO: 2578 - protein, 8 aa, Artificial Sequence
  Representative cyclic modulating agent based on PB-cadherin cell adhesion recognition sequence
KIDADTGE

SEQ ID NO: 2579 - protein, 7 aa, Artificial Sequence
  Representative cyclic modulating agent based on PB-cadherin cell adhesion recognition sequence
KDIDADE

SEQ ID NO: 2580 - protein, 8 aa, Artificial Sequence
  Representative cyclic modulating agent based on PB-cadherin cell adhesion recognition sequence
KDIDADTE

SEQ ID NO: 2581 - protein, 9 aa, Artificial Sequence
  Representative cyclic modulating agent based on PB-cadherin cell adhesion recognition sequence
KDIDADTGE

SEQ ID NO: 2582 - protein, 8 aa, Artificial Sequence
  Representative cyclic modulating agent based on PB-cadherin cell adhesion recognition sequence
KFDIDADE

SEQ ID NO: 2583 - protein, 9 aa, Artificial Sequence
  Representative cyclic modulating agent based on PB-cadherin cell adhesion recognition sequence
KFDIDADTE

SEQ ID NO: 2584 - protein, 10 aa, Artificial Sequence
  Representative cyclic modulating agent based on PB-cadherin cell adhesion recognition sequence
KFDIDADTGE

SEQ ID NO: 2585 - protein, 9 aa, Artificial Sequence
  Representative cyclic modulating agent based on PB-cadherin cell adhesion recognition sequence
KIFDIDADE

SEQ ID NO: 2586 - protein, 10 aa, Artificial Sequence
  Representative cyclic modulating agent based on PB-cadherin cell adhesion recognition sequence
KIFDIDADTE

SEQ ID NO: 2587 - protein, 11 aa, Artificial Sequence
  Representative cyclic modulating agent based on PB-cadherin cell adhesion recognition sequence
KIFDIDADTGE

SEQ ID NO: 2588 - protein, 5 aa, Artificial Sequence
  Representative cyclic modulating agent based on PB-cadherin cell adhesion recognition sequence
VEEYT

SEQ ID NO: 2589 - protein, 6 aa, Artificial Sequence
  Representative cyclic modulating agent based on PB-cadherin cell adhesion recognition sequence
VEEYTG

SEQ ID NO: 2590 - protein, 5 aa, Artificial Sequence
  Representative cyclic modulating agent based on PB-cadherin cell adhesion recognition sequence
VVEEY

SEQ ID NO: 2591 - protein, 6 aa, Artificial Sequence
  Representative cyclic modulating agent based on PB-cadherin cell adhesion recognition sequence
VVEEYT

SEQ ID NO: 2592 - protein, 7 aa, Artificial Sequence
  Representative cyclic modulating agent based on PB-cadherin cell adhesion recognition sequence
VVEEYTG

SEQ ID NO: 2593 - protein, 6 aa, Artificial Sequence
  Representative cyclic modulating agent based on PB-cadherin cell adhesion recognition sequence
FVVEEY

SEQ ID NO: 2594 - protein, 6 aa, Artificial Sequence
  Representative cyclic modulating agent based on PB-cadherin cell adhesion recognition sequence
FVEEYT

SEQ ID NO: 2595 - protein, 7 aa, Artificial Sequence
  Representative cyclic modulating agent based on PB-cadherin cell adhesion recognition sequence
FVEEYTG

SEQ ID NO: 2596 - protein, 7 aa, Artificial Sequence
  Representative cyclic modulating agent based on PB-cadherin cell adhesion recognition sequence
FFVVEEY

SEQ ID NO: 2597 - protein, 8 aa, Artificial Sequence
  Representative cyclic modulating agent based on PB-cadherin cell adhesion recognition sequence
FFVVEEYT

SEQ ID NO: 2598 - protein, 9 aa, Artificial Sequence
  Representative cyclic modulating agent based on PB-cadherin cell adhesion recognition sequence
FFVVEEYTG

SEQ ID NO: 2599 - protein, 5 aa, Artificial Sequence
  Representative cyclic modulating agent based on PB-cadherin cell adhesion recognition sequence
LIDEL

SEQ ID NO: 2600 - protein, 6 aa, Artificial Sequence
  Representative cyclic modulating agent based on PB-cadherin cell adhesion recognition sequence
LIDELT

SEQ ID NO: 2601 - protein, 7 aa, Artificial Sequence
  Representative cyclic modulating agent based on PB-cadherin cell adhesion recognition sequence
LIDELTG

SEQ ID NO: 2602 - protein, 6 aa, Artificial Sequence
  Representative cyclic modulating agent based on PB-cadherin cell adhesion recognition sequence
FLIDEL

SEQ ID NO: 2603 - protein, 7 aa, Artificial Sequence
  Representative cyclic modulating agent based on PB-cadherin cell adhesion recognition sequence
FLIDELT

SEQ ID NO: 2604 - protein, 8 aa, Artificial Sequence
  Representative cyclic modulating agent based on PB-cadherin cell adhesion recognition sequence
FLIDELTG

SEQ ID NO: 2605 - protein, 7 aa, Artificial Sequence
  Representative cyclic modulating agent based on PB-cadherin cell adhesion recognition sequence
IFLIDEL

SEQ ID NO: 2606 - protein, 8 aa, Artificial Sequence
  Representative cyclic modulating agent based on PB-cadherin cell adhesion recognition sequence
IFLIDELT

SEQ ID NO: 2607 - protein, 9 aa, Artificial Sequence
  Representative cyclic modulating agent based on PB-cadherin cell adhesion recognition sequence
IFLIDELTG

SEQ ID NO: 2608 - protein, 5 aa, Artificial Sequence
  Representative cyclic modulating agent based on PB-cadherin cell adhesion recognition sequence
TVDPK

SEQ ID NO: 2609 - protein, 6 aa, Artificial Sequence
  Representative cyclic modulating agent based on PB-cadherin cell adhesion recognition sequence
TVDPKT

SEQ ID NO: 2610 - protein, 7 aa, Artificial Sequence
  Representative cyclic modulating agent based on PB-cadherin cell adhesion recognition sequence
TVDPKTG

SEQ ID NO: 2611 - protein, 6 aa, Artificial Sequence
  Representative cyclic modulating agent based on PB-cadherin cell adhesion recognition sequence
FTVDPK

SEQ ID NO: 2612 - protein, 7 aa, Artificial Sequence
  Representative cyclic modulating agent based on PB-cadherin cell adhesion recognition sequence
FTVDPKT

SEQ ID NO: 2613 - protein, 8 aa, Artificial Sequence
  Representative cyclic modulating agent based on PB-cadherin cell adhesion recognition sequence
FTVDPKTG

SEQ ID NO: 2614 - protein, 7 aa, Artificial Sequence
  Representative cyclic modulating agent based on PB-cadherin cell adhesion recognition sequence
HFTVDPK

SEQ ID NO: 2615 - protein, 8 aa, Artificial Sequence
  Representative cyclic modulating agent based on PB-cadherin cell adhesion recognition sequence
HFTVDPKT

SEQ ID NO: 2616 - protein, 9 aa, Artificial Sequence
  Representative cyclic modulating agent based on PB-cadherin cell adhesion recognition sequence
HFTVDPKTG

SEQ ID NO: 2617 - protein, 5 aa, Artificial Sequence
  Representative cyclic modulating agent based on PB-cadherin cell adhesion recognition sequence
DADTG

SEQ ID NO: 2618 - protein, 5 aa, Artificial Sequence
  Representative cyclic modulating agent based on PB-cadherin cell adhesion recognition sequence
IDADT

SEQ ID NO: 2619 - protein, 6 aa, Artificial Sequence
  Representative cyclic modulating agent based on PB-cadherin cell adhesion recognition sequence
IDADTG

SEQ ID NO: 2620 - protein, 5 aa, Artificial Sequence
  Representative cyclic modulating agent based on PB-cadherin cell adhesion recognition sequence
DIDAD

SEQ ID NO: 2621 - protein, 6 aa, Artificial Sequence
  Representative cyclic modulating agent based on PB-cadherin cell adhesion recognition sequence
DIDADT

SEQ ID NO: 2622 - protein, 7 aa, Artificial Sequence
  Representative cyclic modulating agent based on PB-cadherin cell adhesion recognition sequence
DIDADTG

SEQ ID NO: 2623 - protein, 6 aa, Artificial Sequence
  Representative cyclic modulating agent based on PB-cadherin cell adhesion recognition sequence
FDIDAD

SEQ ID NO: 2624 - protein, 7 aa, Artificial Sequence
  Representative cyclic modulating agent based on PB-cadherin cell adhesion recognition sequence
FDIDADT

SEQ ID NO: 2625 - protein, 8 aa, Artificial Sequence
  Representative cyclic modulating agent based on PB-cadherin cell adhesion recognition sequence
FDIDADTG

SEQ ID NO: 2626 - protein, 7 aa, Artificial Sequence
  Representative cyclic modulating agent based on PB-cadherin cell adhesion recognition sequence
IFDIDAD

SEQ ID NO: 2627 - protein, 8 aa, Artificial Sequence
  Representative cyclic modulating agent based on PB-cadherin cell adhesion recognition sequence
IFDIDADT

SEQ ID NO: 2628 - protein, 9 aa, Artificial Sequence
  Representative cyclic modulating agent based on PB-cadherin cell adhesion recognition sequence
IFDIDADTG

SEQ ID NO: 2629 - protein, 5 aa, Artificial Sequence
  Representative cyclic modulating agent based on LI-cadherin cell adhesion recognition sequence
CNNKC

SEQ ID NO: 2630 - protein, 6 aa, Artificial Sequence
  Representative cyclic modulating agent based on LI-cadherin cell adhesion recognition sequence
CNNKTC

SEQ ID NO: 2631 - protein, 7 aa, Artificial Sequence
  Representative cyclic modulating agent based on LI-cadherin cell adhesion recognition sequence
CNNKTGC

SEQ ID NO: 2632 - protein, 6 aa, Artificial Sequence
  Representative cyclic modulating agent based on LI-cadherin cell adhesion recognition sequence
CINNKC

SEQ ID NO: 2633 - protein, 7 aa, Artificial Sequence
  Representative cyclic modulating agent based on LI-cadherin cell adhesion recognition sequence
CINNKTC

SEQ ID NO: 2634 - protein, 8 aa, Artificial Sequence
  Representative cyclic modulating agent based on LI-cadherin cell adhesion recognition sequence
CINNKTGC

SEQ ID NO: 2635 - protein, 7 aa, Artificial Sequence
  Representative cyclic modulating agent based on LI-cadherin cell adhesion recognition sequence
CQINNKC

SEQ ID NO: 2636 - protein, 8 aa, Artificial Sequence
  Representative cyclic modulating agent based on LI-cadherin cell adhesion recognition sequence
CQINNKTC

SEQ ID NO: 2637 - protein, 9 aa, Artificial Sequence
  Representative cyclic modulating agent based on LI-cadherin cell adhesion recognition sequence
CQINNKTGC

SEQ ID NO: 2638 - protein, 8 aa, Artificial Sequence
  Representative cyclic modulating agent based on LI-cadherin cell adhesion recognition sequence
CFQINNKC

SEQ ID NO: 2639 - protein, 9 aa, Artificial Sequence
  Representative cyclic modulating agent based on LI-cadherin cell adhesion recognition sequence
CFQINNKTC

SEQ ID NO: 2640 - protein, 10 aa, Artificial Sequence
  Representative cyclic modulating agent based on LI-cadherin cell adhesion recognition sequence
CFQINNKTGC

SEQ ID NO: 2641 - protein, 9 aa, Artificial Sequence
  Representative cyclic modulating agent based on LI-cadherin cell adhesion recognition sequence
CYFQINNKC

SEQ ID NO: 2642 - protein, 10 aa, Artificial Sequence
  Representative cyclic modulating agent based on LI-cadherin cell adhesion recognition sequence
CYFQINNKTC

SEQ ID NO: 2643 - protein, 11 aa, Artificial Sequence
  Representative cyclic modulating agent based on LI-cadherin cell adhesion recognition sequence
CYFQINNKTGC

SEQ ID NO: 2644 - protein, 5 aa, Artificial Sequence
  Representative cyclic modulating agent based on LI-cadherin cell adhesion recognition sequence
ENNKK

SEQ ID NO: 2645 - protein, 6 aa, Artificial Sequence
  Representative cyclic modulating agent based on LI-cadherin cell adhesion recognition sequence
ENNKTK

SEQ ID NO: 2646 - protein, 7 aa, Artificial Sequence
  Representative cyclic modulating agent based on LI-cadherin cell adhesion recognition sequence
ENNKTGK

SEQ ID NO: 2647 - protein, 6 aa, Artificial Sequence
  Representative cyclic modulating agent based on LI-cadherin cell adhesion recognition sequence
EINNKK

SEQ ID NO: 2648 - protein, 7 aa, Artificial Sequence
  Representative cyclic modulating agent based on LI-cadherin cell adhesion recognition sequence
EINNKTK

SEQ ID NO: 2649 - protein, 8 aa, Artificial Sequence
  Representative cyclic modulating agent based on LI-cadherin cell adhesion recognition sequence
EINNKTGK

SEQ ID NO: 2650 - protein, 7 aa, Artificial Sequence
  Representative cyclic modulating agent based on LI-cadherin cell adhesion recognition sequence
EQINNKK

SEQ ID NO: 2651 - protein, 8 aa, Artificial Sequence
  Representative cyclic modulating agent based on LI-cadherin cell adhesion recognition sequence
EQINNKTK

SEQ ID NO: 2652 - protein, 9 aa, Artificial Sequence
  Representative cyclic modulating agent based on LI-cadherin cell adhesion recognition sequence
EQINNKTGK

SEQ ID NO: 2653 - protein, 8 aa, Artificial Sequence
  Representative cyclic modulating agent based on LI-cadherin cell adhesion recognition sequence
EFQINNKK

SEQ ID NO: 2654 - protein, 9 aa, Artificial Sequence
  Representative cyclic modulating agent based on LI-cadherin cell adhesion recognition sequence
EFQINNKTK

SEQ ID NO: 2655 - protein, 10 aa, Artificial Sequence
  Representative cyclic modulating agent based on LI-cadherin cell adhesion recognition sequence
EFQINNKTGK

SEQ ID NO: 2656 - protein, 9 aa, Artificial Sequence
  Representative cyclic modulating agent based on LI-cadherin cell adhesion recognition sequence
EYFQINNKK

SEQ ID NO: 2657 - protein, 10 aa, Artificial Sequence
  Representative cyclic modulating agent based on LI-cadherin cell adhesion recognition sequence
EYFQINNKTK

SEQ ID NO: 2658 - protein, 11 aa, Artificial Sequence
  Representative cyclic modulating agent based on LI-cadherin cell adhesion recognition sequence
EYFQINNKTGK

SEQ ID NO: 2659 - protein, 5 aa, Artificial Sequence
  Representative cyclic modulating agent based on LI-cadherin cell adhesion recognition sequence
KNNKD

SEQ ID NO: 2660 - protein, 6 aa, Artificial Sequence
  Representative cyclic modulating agent based on LI-cadherin cell adhesion recognition sequence
KNNKTD

SEQ ID NO: 2661 - protein, 7 aa, Artificial Sequence
  Representative cyclic modulating agent based on LI-cadherin cell adhesion recognition sequence
KNNKTGD

SEQ ID NO: 2662 - protein, 6 aa, Artificial Sequence
  Representative cyclic modulating agent based on LI-cadherin cell adhesion recognition sequence
KINNKD

SEQ ID NO: 2663 - protein, 7 aa, Artificial Sequence
  Representative cyclic modulating agent based on LI-cadherin cell adhesion recognition sequence
KINNKTD

SEQ ID NO: 2664 - protein, 8 aa, Artificial Sequence
  Representative cyclic modulating agent based on LI-cadherin cell adhesion recognition sequence
KINNKTGD

SEQ ID NO: 2665 - protein, 7 aa, Artificial Sequence
  Representative cyclic modulating agent based on LI-cadherin cell adhesion recognition sequence
KQINNKD

SEQ ID NO: 2666 - protein, 8 aa, Artificial Sequence
  Representative cyclic modulating agent based on LI-cadherin cell adhesion recognition sequence
KQINNKTD

SEQ ID NO: 2667 - protein, 9 aa, Artificial Sequence
  Representative cyclic modulating agent based on LI-cadherin cell adhesion recognition sequence
KQINNKTGD

SEQ ID NO: 2668 - protein, 8 aa, Artificial Sequence
  Representative cyclic modulating agent based on LI-cadherin cell adhesion recognition sequence
KFQINNKD

SEQ ID NO: 2669 - protein, 9 aa, Artificial Sequence
  Representative cyclic modulating agent based on LI-cadherin cell adhesion recognition sequence
KFQINNKTD

SEQ ID NO: 2670 - protein, 10 aa, Artificial Sequence
  Representative cyclic modulating agent based on LI-cadherin cell adhesion recognition sequence
KFQINNKTGD

SEQ ID NO: 2671 - protein, 9 aa, Artificial Sequence
  Representative cyclic modulating agent based on LI-cadherin cell adhesion recognition sequence
KYFQINNKD

SEQ ID NO: 2672 - protein, 10 aa, Artificial Sequence
  Representative cyclic modulating agent based on LI-cadherin cell adhesion recognition sequence
KYFQINNKTD

SEQ ID NO: 2673 - protein, 11 aa, Artificial Sequence
  Representative cyclic modulating agent based on LI-cadherin cell adhesion recognition sequence
KYFQINNKTGD

SEQ ID NO: 2674 - protein, 5 aa, Artificial Sequence
  Representative cyclic modulating agent based on LI-cadherin cell adhesion recognition sequence
DNNKK

SEQ ID NO: 2675 - protein, 6 aa, Artificial Sequence
  Representative cyclic modulating agent based on LI-cadherin cell adhesion recognition sequence
DNNKTK

SEQ ID NO: 2676 - protein, 7 aa, Artificial Sequence
  Representative cyclic modulating agent based on LI-cadherin cell adhesion recognition sequence
DNNKTGK

SEQ ID NO: 2677 - protein, 6 aa, Artificial Sequence
  Representative cyclic modulating agent based on LI-cadherin cell adhesion recognition sequence
DINNKK

SEQ ID NO: 2678 - protein, 7 aa, Artificial Sequence
  Representative cyclic modulating agent based on LI-cadherin cell adhesion recognition sequence
DINNKTK

SEQ ID NO: 2679 - protein, 8 aa, Artificial Sequence
  Representative cyclic modulating agent based on LI-cadherin cell adhesion recognition sequence
DINNKTGK

SEQ ID NO: 2680 - protein, 7 aa, Artificial Sequence
  Representative cyclic modulating agent based on LI-cadherin cell adhesion recognition sequence
DQINNKK

SEQ ID NO: 2681 - protein, 8 aa, Artificial Sequence
  Representative cyclic modulating agent based on LI-cadherin cell adhesion recognition sequence
DQINNKTK

SEQ ID NO: 2682 - protein, 9 aa, Artificial Sequence
  Representative cyclic modulating agent based on LI-cadherin cell adhesion recognition sequence
DQINNKTGK

SEQ ID NO: 2683 - protein, 8 aa, Artificial Sequence
  Representative cyclic modulating agent based on LI-cadherin cell adhesion recognition sequence
DFQINNKK

SEQ ID NO: 2684 - protein, 9 aa, Artificial Sequence
  Representative cyclic modulating agent based on LI-cadherin cell adhesion recognition sequence
DFQINNKTK

SEQ ID NO: 2685 - protein, 10 aa, Artificial Sequence
  Representative cyclic modulating agent based on LI-cadherin cell adhesion recognition sequence
DFQINNKTGK

SEQ ID NO: 2686 - protein, 9 aa, Artificial Sequence
  Representative cyclic modulating agent based on LI-cadherin cell adhesion recognition sequence
DYFQINNKK

SEQ ID NO: 2687 - protein, 10 aa, Artificial Sequence
  Representative cyclic modulating agent based on LI-cadherin cell adhesion recognition sequence
DYFQINNKTK

SEQ ID NO: 2688 - protein, 11 aa, Artificial Sequence
  Representative cyclic modulating agent based on LI-cadherin cell adhesion recognition sequence
DYFQINNKTGK

SEQ ID NO: 2689 - protein, 5 aa, Artificial Sequence
  Representative cyclic modulating agent based on LI-cadherin cell adhesion recognition sequence
KNNKE

SEQ ID NO: 2690 - protein, 6 aa, Artificial Sequence
  Representative cyclic modulating agent based on LI-cadherin cell adhesion recognition sequence
KNNKTE

SEQ ID NO: 2691 - protein, 7 aa, Artificial Sequence
  Representative cyclic modulating agent based on LI-cadherin cell adhesion recognition sequence
KNNKTGE

SEQ ID NO: 2692 - protein, 6 aa, Artificial Sequence
  Representative cyclic modulating agent based on LI-cadherin cell adhesion recognition sequence
KINNKE

SEQ ID NO: 2693 - protein, 7 aa, Artificial Sequence
  Representative cyclic modulating agent based on LI-cadherin cell adhesion recognition sequence
KINNKTE

SEQ ID NO: 2694 - protein, 8 aa, Artificial Sequence
  Representative cyclic modulating agent based on LI-cadherin cell adhesion recognition sequence
KINNKTGE

SEQ ID NO: 2695 - protein, 7 aa, Artificial Sequence
  Representative cyclic modulating agent based on LI-cadherin cell adhesion recognition sequence
KQINNKE

SEQ ID NO: 2696 - protein, 8 aa, Artificial Sequence
  Representative cyclic modulating agent based on LI-cadherin cell adhesion recognition sequence
KQINNKTE

SEQ ID NO: 2697 - protein, 9 aa, Artificial Sequence
  Representative cyclic modulating agent based on LI-cadherin cell adhesion recognition sequence
KQINNKTGE

SEQ ID NO: 2698 - protein, 8 aa, Artificial Sequence
  Representative cyclic modulating agent based on LI-cadherin cell adhesion recognition sequence
KFQINNKE

SEQ ID NO: 2699 - protein, 9 aa, Artificial Sequence
  Representative cyclic modulating agent based on LI-cadherin cell adhesion recognition sequence
KFQINNKTE

SEQ ID NO: 2700 - protein, 10 aa, Artificial Sequence
  Representative cyclic modulating agent based on LI-cadherin cell adhesion recognition sequence
KFQINNKTGE

SEQ ID NO: 2701 - protein, 9 aa, Artificial Sequence
  Representative cyclic modulating agent based on LI-cadherin cell adhesion recognition sequence
KYFQINNKE

SEQ ID NO: 2702 - protein, 10 aa, Artificial Sequence
  Representative cyclic modulating agent based on LI-cadherin cell adhesion recognition sequence
KYFQINNKTE

SEQ ID NO: 2703 - protein, 11 aa, Artificial Sequence
  Representative cyclic modulating agent based on LI-cadherin cell adhesion recognition sequence
KYFQINNKTGE

SEQ ID NO: 2704 - protein, 5 aa, Artificial Sequence
  Representative cyclic modulating agent based on LI-cadherin cell adhesion recognition sequence
NNKTG

SEQ ID NO: 2705 - protein, 5 aa, Artificial Sequence
  Representative cyclic modulating agent based on LI-cadherin cell adhesion recognition sequence
INNKT

SEQ ID NO: 2706 - protein, 6 aa, Artificial Sequence
  Representative cyclic modulating agent based on LI-cadherin cell adhesion recognition sequence
INNKTG

SEQ ID NO: 2707 - protein, 5 aa, Artificial Sequence
  Representative cyclic modulating agent based on LI-cadherin cell adhesion recognition sequence
QINNK

SEQ ID NO: 2708 - protein, 6 aa, Artificial Sequence
  Representative cyclic modulating agent based on LI-cadherin cell adhesion recognition sequence
QINNKT

SEQ ID NO: 2709 - protein, 7 aa, Artificial Sequence
  Representative cyclic modulating agent based on LI-cadherin cell adhesion recognition sequence
QINNKTG

SEQ ID NO: 2710 - protein, 6 aa, Artificial Sequence
  Representative cyclic modulating agent based on LI-cadherin cell adhesion recognition sequence
FQINNK

SEQ ID NO: 2711 - protein, 7 aa, Artificial Sequence
  Representative cyclic modulating agent based on LI-cadherin cell adhesion recognition sequence
FQINNKT

SEQ ID NO: 2712 - protein, 8 aa, Artificial Sequence
  Representative cyclic modulating agent based on LI-cadherin cell adhesion recognition sequence
FQINNKTG

SEQ ID NO: 2713 - protein, 7 aa, Artificial Sequence
  Representative cyclic modulating agent based on LI-cadherin cell adhesion recognition sequence
YFQINNK

SEQ ID NO: 2714 - protein, 8 aa, Artificial Sequence
  Representative cyclic modulating agent based on LI-cadherin cell adhesion recognition sequence
YFQINNKT

SEQ ID NO: 2715 - protein, 9 aa, Artificial Sequence
  Representative cyclic modulating agent based on LI-cadherin cell adhesion recognition sequence
YFQINNKTG

SEQ ID NO: 2716 - protein, 5 aa, Artificial Sequence
  Representative cyclic modulating agent based on Protocadherin cell adhesion recognition sequence
CDLVC

SEQ ID NO: 2717 - protein, 6 aa, Artificial Sequence
  Representative cyclic modulating agent based on Protocadherin cell adhesion recognition sequence
CDLVTC

SEQ ID NO: 2718 - protein, 7 aa, Artificial Sequence
  Representative cyclic modulating agent based on Protocadherin cell adhesion recognition sequence
CDLVTGC

SEQ ID NO: 2719 - protein, 6 aa, Artificial Sequence
  Representative cyclic modulating agent based on Protocadherin cell adhesion recognition sequence
CLDLVC

SEQ ID NO: 2720 - protein, 7 aa, Artificial Sequence
  Representative cyclic modulating agent based on Protocadherin cell adhesion recognition sequence
CLDLVTC

SEQ ID NO: 2721 - protein, 8 aa, Artificial Sequence
  Representative cyclic modulating agent based on Protocadherin cell adhesion recognition sequence
CLDLVTGC

SEQ ID NO: 2722 - protein, 7 aa, Artificial Sequence
  Representative cyclic modulating agent based on Protocadherin cell adhesion recognition sequence
CALDLVC

SEQ ID NO: 2723 - protein, 8 aa, Artificial Sequence
  Representative cyclic modulating agent based on Protocadherin cell adhesion recognition sequence
CALDLVTC

SEQ ID NO: 2724 - protein, 9 aa, Artificial Sequence
  Representative cyclic modulating agent based on Protocadherin cell adhesion recognition sequence
CALDLVTGC

SEQ ID NO: 2725 - protein, 8 aa, Artificial Sequence
  Representative cyclic modulating agent based on Protocadherin cell adhesion recognition sequence
CFALDLVC

SEQ ID NO: 2726 - protein, 9 aa, Artificial Sequence
  Representative cyclic modulating agent based on Protocadherin cell adhesion recognition sequence
CFALDLVTC

SEQ ID NO: 2727 - protein, 10 aa, Artificial Sequence
  Representative cyclic modulating agent based on Protocadherin cell adhesion recognition sequence
CFALDLVTGC

SEQ ID NO: 2728 - protein, 9 aa, Artificial Sequence
  Representative cyclic modulating agent based on Protocadherin cell adhesion recognition sequence
CLFALDLVC

SEQ ID NO: 2729 - protein, 10 aa, Artificial Sequence
  Representative cyclic modulating agent based on Protocadherin cell adhesion recognition sequence
CLFALDLVTC

SEQ ID NO: 2730 - protein, 11 aa, Artificial Sequence
  Representative cyclic modulating agent based on Protocadherin cell adhesion recognition sequence
CLFALDLVTGC

SEQ ID NO: 2731 - protein, 5 aa, Artificial Sequence
  Representative cyclic modulating agent based on Protocadherin cell adhesion recognition sequence
CNRDC

SEQ ID NO: 2732 - protein, 6 aa, Artificial Sequence
  Representative cyclic modulating agent based on Protocadherin cell adhesion recognition sequence
CNRDNC

SEQ ID NO: 2733 - protein, 7 aa, Artificial Sequence
  Representative cyclic modulating agent based on Protocadherin cell adhesion recognition sequence
CNRDNGC

SEQ ID NO: 2734 - protein, 6 aa, Artificial Sequence
  Representative cyclic modulating agent based on Protocadherin cell adhesion recognition sequence
CINRDC

SEQ ID NO: 2735 - protein, 7 aa, Artificial Sequence
  Representative cyclic modulating agent based on Protocadherin cell adhesion recognition sequence
CINRDNC

SEQ ID NO: 2736 - protein, 8 aa, Artificial Sequence
  Representative cyclic modulating agent based on Protocadherin cell adhesion recognition sequence
CINRDNGC

SEQ ID NO: 2737 - protein, 7 aa, Artificial Sequence
  Representative cyclic modulating agent based on Protocadherin cell adhesion recognition sequence
CTINRDC

SEQ ID NO: 2738 - protein, 8 aa, Artificial Sequence
  Representative cyclic modulating agent based on Protocadherin cell adhesion recognition sequence
CTINRDNC

SEQ ID NO: 2739 - protein, 9 aa, Artificial Sequence
  Representative cyclic modulating agent based on Protocadherin cell adhesion recognition sequence
CTINRDNGC

SEQ ID NO: 2740 - protein, 8 aa, Artificial Sequence
  Representative cyclic modulating agent based on Protocadherin cell adhesion recognition sequence
CFTINRDC

SEQ ID NO: 2741 - protein, 9 aa, Artificial Sequence
  Representative cyclic modulating agent based on Protocadherin cell adhesion recognition sequence
CFTINRDNC

SEQ ID NO: 2742 - protein, 10 aa, Artificial Sequence
  Representative cyclic modulating agent based on Protocadherin cell adhesion recognition sequence
CFTINRDNGC

SEQ ID NO: 2743 - protein, 9 aa, Artificial Sequence
  Representative cyclic modulating agent based on Protocadherin cell adhesion recognition sequence
CYFTINRDC

SEQ ID NO: 2744 - protein, 10 aa, Artificial Sequence
  Representative cyclic modulating agent based on Protocadherin cell adhesion recognition sequence
CYFTINRDNC

SEQ ID NO: 2745 - protein, 11 aa, Artificial Sequence
  Representative cyclic modulating agent based on Protocadherin cell adhesion recognition sequence
CYFTINRDNGC

SEQ ID NO: 2746 - protein, 5 aa, Artificial Sequence
  Representative cyclic modulating agent based on Protocadherin cell adhesion recognition sequence
CDPSC

SEQ ID NO: 2747 - protein, 6 aa, Artificial Sequence
  Representative cyclic modulating agent based on Protocadherin cell adhesion recognition sequence
CDPSSC

SEQ ID NO: 2748 - protein, 7 aa, Artificial Sequence
  Representative cyclic modulating agent based on Protocadherin cell adhesion recognition sequence
CDPSSGC

SEQ ID NO: 2749 - protein, 6 aa, Artificial Sequence
  Representative cyclic modulating agent based on Protocadherin cell adhesion recognition sequence
CIDPSC

SEQ ID NO: 2750 - protein, 7 aa, Artificial Sequence
  Representative cyclic modulating agent based on Protocadherin cell adhesion recognition sequence
CIDPSSC

SEQ ID NO: 2751 - protein, 8 aa, Artificial Sequence
  Representative cyclic modulating agent based on Protocadherin cell adhesion recognition sequence
CIDPSSGC

SEQ ID NO: 2752 - protein, 7 aa, Artificial Sequence
  Representative cyclic modulating agent based on Protocadherin cell adhesion recognition sequence
CEIDPSC

SEQ ID NO: 2753 - protein, 8 aa, Artificial Sequence
  Representative cyclic modulating agent based on Protocadherin cell adhesion recognition sequence
CEIDPSSC

SEQ ID NO: 2754 - protein, 9 aa, Artificial Sequence
  Representative cyclic modulating agent based on Protocadherin cell adhesion recognition sequence
CEIDPSSGC

SEQ ID NO: 2755 - protein, 8 aa, Artificial Sequence
  Representative cyclic modulating agent based on Protocadherin cell adhesion recognition sequence
CFEIDPSC

SEQ ID NO: 2756 - protein, 9 aa, Artificial Sequence
  Representative cyclic modulating agent based on Protocadherin cell adhesion recognition sequence
CFEIDPSSC

SEQ ID NO: 2757 - protein, 9 aa, Artificial Sequence
  Representative cyclic modulating agent based on Protocadherin cell adhesion recognition sequence
CEIDPSSGC

SEQ ID NO: 2758 - protein, 8 aa, Artificial Sequence
  Representative cyclic modulating agent based on Protocadherin cell adhesion recognition sequence
CFEIDPSC

SEQ ID NO: 2759 - protein, 9 aa, Artificial Sequence
  Representative cyclic modulating agent based on Protocadherin cell adhesion recognition sequence
CFEIDPSSC

SEQ ID NO: 2760 - protein, 10 aa, Artificial Sequence
  Representative cyclic modulating agent based on Protocadherin cell adhesion recognition sequence
CFEIDPSSGC

SEQ ID NO: 2761 - protein, 9 aa, Artificial Sequence
  Representative cyclic modulating agent based on Protocadherin cell adhesion recognition sequence
CLFEIDPSC

SEQ ID NO: 2762 - protein, 10 aa, Artificial Sequence
  Representative cyclic modulating agent based on Protocadherin cell adhesion recognition sequence
CLFEIDPSSC

SEQ ID NO: 2763 - protein, 11 aa, Artificial Sequence
  Representative cyclic modulating agent based on Protocadherin cell adhesion recognition sequence
CLFEIDPSSGC

SEQ ID NO: 2764 - protein, 5 aa, Artificial Sequence
  Representative cyclic modulating agent based on Protocadherin cell adhesion recognition sequence
EDLVK

SEQ ID NO: 2765 - protein, 6 aa, Artificial Sequence
  Representative cyclic modulating agent based on Protocadherin cell adhesion recognition sequence
EDLVTK

SEQ ID NO: 2766 - protein, 7 aa, Artificial Sequence
  Representative cyclic modulating agent based on Protocadherin cell adhesion recognition sequence
EDLVTGK

SEQ ID NO: 2767 - protein, 6 aa, Artificial Sequence
  Representative cyclic modulating agent based on Protocadherin cell adhesion recognition sequence
ELDLVK

SEQ ID NO: 2768 - protein, 7 aa, Artificial Sequence
  Representative cyclic modulating agent based on Protocadherin cell adhesion recognition sequence
ELDLVTK

SEQ ID NO: 2769 - protein, 8 aa, Artificial Sequence
  Representative cyclic modulating agent based on Protocadherin cell adhesion recognition sequence
ELDLVTGK

SEQ ID NO: 2770 - protein, 7 aa, Artificial Sequence
  Representative cyclic modulating agent based on Protocadherin cell adhesion recognition sequence
EALDLVK

SEQ ID NO: 2771 - protein, 8 aa, Artificial Sequence
  Representative cyclic modulating agent based on Protocadherin cell adhesion recognition sequence
EALDLVTK

SEQ ID NO: 2772 - protein, 9 aa, Artificial Sequence
  Representative cyclic modulating agent based on Protocadherin cell adhesion recognition sequence
EALDLVTGK

SEQ ID NO: 2773 - protein, 8 aa, Artificial Sequence
  Representative cyclic modulating agent based on Protocadherin cell adhesion recognition sequence
EFALDLVK

SEQ ID NO: 2774 - protein, 9 aa, Artificial Sequence
  Representative cyclic modulating agent based on Protocadherin cell adhesion recognition sequence
EFALDLVTK

SEQ ID NO: 2775 - protein, 10 aa, Artificial Sequence
  Representative cyclic modulating agent based on Protocadherin cell adhesion recognition sequence
EFALDLVTGK

SEQ ID NO: 2776 - protein, 9 aa, Artificial Sequence
  Representative cyclic modulating agent based on Protocadherin cell adhesion recognition sequence
ELFALDLVK

SEQ ID NO: 2777 - protein, 10 aa, Artificial Sequence
  Representative cyclic modulating agent based on Protocadherin cell adhesion recognition sequence
ELFALDLVTK

SEQ ID NO: 2778 - protein, 11 aa, Artificial Sequence
  Representative cyclic modulating agent based on Protocadherin cell adhesion recognition sequence
ELFALDLVTGK

SEQ ID NO: 2779 - protein, 5 aa, Artificial Sequence
  Representative cyclic modulating agent based on Protocadherin cell adhesion recognition sequence
ENRDK

SEQ ID NO: 2780 - protein, 6 aa, Artificial Sequence
  Representative cyclic modulating agent based on Protocadherin cell adhesion recognition sequence
ENRDNK

SEQ ID NO: 2781 - protein, 7 aa, Artificial Sequence
  Representative cyclic modulating agent based on Protocadherin cell adhesion recognition sequence
ENRDNGK

SEQ ID NO: 2782 - protein, 6 aa, Artificial Sequence
  Representative cyclic modulating agent based on Protocadherin cell adhesion recognition sequence
EINRDK

SEQ ID NO: 2783 - protein, 7 aa, Artificial Sequence
  Representative cyclic modulating agent based on Protocadherin cell adhesion recognition sequence
EINRDNK

SEQ ID NO: 2784 - protein, 8 aa, Artificial Sequence
  Representative cyclic modulating agent based on Protocadherin cell adhesion recognition sequence
EINRDNGK

SEQ ID NO: 2785 - protein, 7 aa, Artificial Sequence
  Representative cyclic modulating agent based on Protocadherin cell adhesion recognition sequence
ETINRDK

SEQ ID NO: 2786 - protein, 8 aa, Artificial Sequence
  Representative cyclic modulating agent based on Protocadherin cell adhesion recognition sequence
ETINRDNK

SEQ ID NO: 2787 - protein, 9 aa, Artificial Sequence
  Representative cyclic modulating agent based on Protocadherin cell adhesion recognition sequence
ETINRDNGK

SEQ ID NO: 2788 - protein, 8 aa, Artificial Sequence
  Representative cyclic modulating agent based on Protocadherin cell adhesion recognition sequence
EFTINRDK

SEQ ID NO: 2789 - protein, 9 aa, Artificial Sequence
  Representative cyclic modulating agent based on Protocadherin cell adhesion recognition sequence
EFTINRDNK

SEQ ID NO: 2790 - protein, 10 aa, Artificial Sequence
  Representative cyclic modulating agent based on Protocadherin cell adhesion recognition sequence
EFTINRDNGK

SEQ ID NO: 2791 - protein, 9 aa, Artificial Sequence
  Representative cyclic modulating agent based on Protocadherin cell adhesion recognition sequence
EYFTINRDK

SEQ ID NO: 2792 - protein, 10 aa, Artificial Sequence
  Representative cyclic modulating agent based on Protocadherin cell adhesion recognition sequence
EYFTINRDNK

SEQ ID NO: 2793 - protein, 11 aa, Artificial Sequence
  Representative cyclic modulating agent based on Protocadherin cell adhesion recognition sequence
EYFTINRDNGK

SEQ ID NO: 2794 - protein, 5 aa, Artificial Sequence
  Representative cyclic modulating agent based on Protocadherin cell adhesion recognition sequence
EDPKK

SEQ ID NO: 2795 - protein, 6 aa, Artificial Sequence
  Representative cyclic modulating agent based on Protocadherin cell adhesion recognition sequence
EDPKTK

SEQ ID NO: 2796 - protein, 7 aa, Artificial Sequence
  Representative cyclic modulating agent based on Protocadherin cell adhesion recognition sequence
EDPKTGK

SEQ ID NO: 2797 - protein, 6 aa, Artificial Sequence
  Representative cyclic modulating agent based on Protocadherin cell adhesion recognition sequence
EIDPKK

SEQ ID NO: 2798 - protein, 7 aa, Artificial Sequence
  Representative cyclic modulating agent based on Protocadherin cell adhesion recognition sequence
EIDPKTK

SEQ ID NO: 2799 - protein, 8 aa, Artificial Sequence
  Representative cyclic modulating agent based on Protocadherin cell adhesion recognition sequence
EIDPKTGK

SEQ ID NO: 2800 - protein, 7 aa, Artificial Sequence
  Representative cyclic modulating agent based on Protocadherin cell adhesion recognition sequence
ESIDPKK

SEQ ID NO: 2801 - protein, 8 aa, Artificial Sequence
  Representative cyclic modulating agent based on Protocadherin cell adhesion recognition sequence
ESIDPKTK

SEQ ID NO: 2802 - protein, 9 aa, Artificial Sequence
  Representative cyclic modulating agent based on Protocadherin cell adhesion recognition sequence
ESIDPKTGK

SEQ ID NO: 2803 - protein, 8 aa, Artificial Sequence
  Representative cyclic modulating agent based on Protocadherin cell adhesion recognition sequence
EFSIDPKK

SEQ ID NO: 2804 - protein, 9 aa, Artificial Sequence
  Representative cyclic modulating agent based on Protocadherin cell adhesion recognition sequence
EFSIDPKTK

SEQ ID NO: 2805 - protein, 10 aa, Artificial Sequence
  Representative cyclic modulating agent based on Protocadherin cell adhesion recognition sequence
EFSIDPKTGK

SEQ ID NO: 2806 - protein, 9 aa, Artificial Sequence
  Representative cyclic modulating agent based on Protocadherin cell adhesion recognition sequence
ELFSIDPKK

SEQ ID NO: 2807 - protein, 10 aa, Artificial Sequence
  Representative cyclic modulating agent based on Protocadherin cell adhesion recognition sequence
ELFSIDPKTK

SEQ ID NO: 2808 - protein, 11 aa, Artificial Sequence
  Representative cyclic modulating agent based on Protocadherin cell adhesion recognition sequence
ELFSIDPKTGK

SEQ ID NO: 2809 - protein, 5 aa, Artificial Sequence
  Representative cyclic modulating agent based on Protocadherin cell adhesion recognition sequence
EDPSK

SEQ ID NO: 2810 - protein, 6 aa, Artificial Sequence
  Representative cyclic modulating agent based on Protocadherin cell adhesion recognition sequence
EDPSSK

SEQ ID NO: 2811 - protein, 7 aa, Artificial Sequence
  Representative cyclic modulating agent based on Protocadherin cell adhesion recognition sequence
EDPSSGK

SEQ ID NO: 2812 - protein, 6 aa, Artificial Sequence
  Representative cyclic modulating agent based on Protocadherin cell adhesion recognition sequence
EIDPSK

SEQ ID NO: 2813 - protein, 7 aa, Artificial Sequence
  Representative cyclic modulating agent based on Protocadherin cell adhesion recognition sequence
EIDPSSK

SEQ ID NO: 2814 - protein, 8 aa, Artificial Sequence
  Representative cyclic modulating agent based on Protocadherin cell adhesion recognition sequence
EIDPSSGK

SEQ ID NO: 2815 - protein, 7 aa, Artificial Sequence
  Representative cyclic modulating agent based on Protocadherin cell adhesion recognition sequence
EEIDPSK

SEQ ID NO: 2816 - protein, 8 aa, Artificial Sequence
  Representative cyclic modulating agent based on Protocadherin cell adhesion recognition sequence
EEIDPSSK

SEQ ID NO: 2817 - protein, 9 aa, Artificial Sequence
  Representative cyclic modulating agent based on Protocadherin cell adhesion recognition sequence
EEIDPSSGK

SEQ ID NO: 2818 - protein, 8 aa, Artificial Sequence
  Representative cyclic modulating agent based on Protocadherin cell adhesion recognition sequence
EFEIDPSK

SEQ ID NO: 2819 - protein, 9 aa, Artificial Sequence
  Representative cyclic modulating agent based on Protocadherin cell adhesion recognition sequence
EFEIDPSSK

SEQ ID NO: 2820 - protein, 9 aa, Artificial Sequence
  Representative cyclic modulating agent based on Protocadherin cell adhesion recognition sequence
EEIDPSSGK

SEQ ID NO: 2821 - protein, 8 aa, Artificial Sequence
  Representative cyclic modulating agent based on Protocadherin cell adhesion recognition sequence
EFEIDPSK

SEQ ID NO: 2822 - protein, 9 aa, Artificial Sequence
  Representative cyclic modulating agent based on Protocadherin cell adhesion recognition sequence
EFEIDPSSK

SEQ ID NO: 2823 - protein, 10 aa, Artificial Sequence
  Representative cyclic modulating agent based on Protocadherin cell adhesion recognition sequence
EFEIDPSSGK

SEQ ID NO: 2824 - protein, 9 aa, Artificial Sequence
  Representative cyclic modulating agent based on Protocadherin cell adhesion recognition sequence
ELFEIDPSK

SEQ ID NO: 2825 - protein, 10 aa, Artificial Sequence
  Representative cyclic modulating agent based on Protocadherin cell adhesion recognition sequence
ELFEIDPSSK

SEQ ID NO: 2826 - protein, 11 aa, Artificial Sequence
  Representative cyclic modulating agent based on Protocadherin cell adhesion recognition sequence
ELFEIDPSSGK

SEQ ID NO: 2827 - protein, 5 aa, Artificial Sequence
  Representative cyclic modulating agent based on Protocadherin cell adhesion recognition sequence
KDLVD

SEQ ID NO: 2828 - protein, 6 aa, Artificial Sequence
  Representative cyclic modulating agent based on Protocadherin cell adhesion recognition sequence
KDLVTD

SEQ ID NO: 2829 - protein, 7 aa, Artificial Sequence
  Representative cyclic modulating agent based on Protocadherin cell adhesion recognition sequence
KDLVTGD

SEQ ID NO: 2830 - protein, 6 aa, Artificial Sequence
  Representative cyclic modulating agent based on Protocadherin cell adhesion recognition sequence
KLDLVD

SEQ ID NO: 2831 - protein, 7 aa, Artificial Sequence
  Representative cyclic modulating agent based on Protocadherin cell adhesion recognition sequence
KLDLVTD

SEQ ID NO: 2832 - protein, 8 aa, Artificial Sequence
  Representative cyclic modulating agent based on Protocadherin cell adhesion recognition sequence
KLDLVTGD

SEQ ID NO: 2833 - protein, 7 aa, Artificial Sequence
  Representative cyclic modulating agent based on Protocadherin cell adhesion recognition sequence
KALDLVD

SEQ ID NO: 2834 - protein, 8 aa, Artificial Sequence
  Representative cyclic modulating agent based on Protocadherin cell adhesion recognition sequence
KALDLVTD

SEQ ID NO: 2835 - protein, 9 aa, Artificial Sequence
  Representative cyclic modulating agent based on Protocadherin cell adhesion recognition sequence
KALDLVTGD

SEQ ID NO: 2836 - protein, 8 aa, Artificial Sequence
  Representative cyclic modulating agent based on Protocadherin cell adhesion recognition sequence
KFALDLVD

SEQ ID NO: 2837 - protein, 9 aa, Artificial Sequence
  Representative cyclic modulating agent based on Protocadherin cell adhesion recognition sequence
KFALDLVTD

SEQ ID NO: 2838 - protein, 10 aa, Artificial Sequence
  Representative cyclic modulating agent based on Protocadherin cell adhesion recognition sequence
KFALDLVTGD

SEQ ID NO: 2839 - protein, 9 aa, Artificial Sequence
  Representative cyclic modulating agent based on Protocadherin cell adhesion recognition sequence
KLFALDLVD

SEQ ID NO: 2840 - protein, 10 aa, Artificial Sequence
  Representative cyclic modulating agent based on Protocadherin cell adhesion recognition sequence
KLFALDLVTD

SEQ ID NO: 2841 - protein, 11 aa, Artificial Sequence
  Representative cyclic modulating agent based on Protocadherin cell adhesion recognition sequence
KLFALDLVTGD

SEQ ID NO: 2842 - protein, 5 aa, Artificial Sequence
  Representative cyclic modulating agent based on Protocadherin cell adhesion recognition sequence
KNRDD

SEQ ID NO: 2843 - protein, 6 aa, Artificial Sequence
  Representative cyclic modulating agent based on Protocadherin cell adhesion recognition sequence
KNRDND

SEQ ID NO: 2844 - protein, 7 aa, Artificial Sequence
  Representative cyclic modulating agent based on Protocadherin cell adhesion recognition sequence
KNRDNGD

SEQ ID NO: 2845 - protein, 6 aa, Artificial Sequence
  Representative cyclic modulating agent based on Protocadherin cell adhesion recognition sequence
KINRDD

SEQ ID NO: 2846 - protein, 7 aa, Artificial Sequence
  Representative cyclic modulating agent based on Protocadherin cell adhesion recognition sequence
KINRDND

SEQ ID NO: 2847 - protein, 8 aa, Artificial Sequence
  Representative cyclic modulating agent based on Protocadherin cell adhesion recognition sequence
KINRDNGD

SEQ ID NO: 2848 - protein, 7 aa, Artificial Sequence
  Representative cyclic modulating agent based on Protocadherin cell adhesion recognition sequence
KTINRDD

SEQ ID NO: 2849 - protein, 8 aa, Artificial Sequence
  Representative cyclic modulating agent based on Protocadherin cell adhesion recognition sequence
KTINRDND

SEQ ID NO: 2850 - protein, 9 aa, Artificial Sequence
  Representative cyclic modulating agent based on Protocadherin cell adhesion recognition sequence
KTINRDNGD

SEQ ID NO: 2851 - protein, 8 aa, Artificial Sequence
  Representative cyclic modulating agent based on Protocadherin cell adhesion recognition sequence
KFTINRDD

SEQ ID NO: 2852 - protein, 9 aa, Artificial Sequence
  Representative cyclic modulating agent based on Protocadherin cell adhesion recognition sequence
KFTINRDND

SEQ ID NO: 2853 - protein, 10 aa, Artificial Sequence
  Representative cyclic modulating agent based on Protocadherin cell adhesion recognition sequence
KFTINRDNGD

SEQ ID NO: 2854 - protein, 9 aa, Artificial Sequence
  Representative cyclic modulating agent based on Protocadherin cell adhesion recognition sequence
KYFTINRDD

SEQ ID NO: 2855 - protein, 10 aa, Artificial Sequence
  Representative cyclic modulating agent based on Protocadherin cell adhesion recognition sequence
KYFTINRDND

SEQ ID NO: 2856 - protein, 11 aa, Artificial Sequence
  Representative cyclic modulating agent based on Protocadherin cell adhesion recognition sequence
KYFTINRDNGD

SEQ ID NO: 2857 - protein, 5 aa, Artificial Sequence
  Representative cyclic modulating agent based on Protocadherin cell adhesion recognition sequence
KDPKD

SEQ ID NO: 2858 - protein, 6 aa, Artificial Sequence
  Representative cyclic modulating agent based on Protocadherin cell adhesion recognition sequence
KDPKTD

SEQ ID NO: 2859 - protein, 7 aa, Artificial Sequence
  Representative cyclic modulating agent based on Protocadherin cell adhesion recognition sequence
KDPKTGD

SEQ ID NO: 2860 - protein, 6 aa, Artificial Sequence
  Representative cyclic modulating agent based on Protocadherin cell adhesion recognition sequence
KIDPKD

SEQ ID NO: 2861 - protein, 7 aa, Artificial Sequence
  Representative cyclic modulating agent based on Protocadherin cell adhesion recognition sequence
KIDPKTD

SEQ ID NO: 2862 - protein, 8 aa, Artificial Sequence
  Representative cyclic modulating agent based on Protocadherin cell adhesion recognition sequence
KIDPKTGD

SEQ ID NO: 2863 - protein, 7 aa, Artificial Sequence
  Representative cyclic modulating agent based on Protocadherin cell adhesion recognition sequence
KSIDPKD

SEQ ID NO: 2864 - protein, 8 aa, Artificial Sequence
  Representative cyclic modulating agent based on Protocadherin cell adhesion recognition sequence
KSIDPKTD

SEQ ID NO: 2865 - protein, 9 aa, Artificial Sequence
  Representative cyclic modulating agent based on Protocadherin cell adhesion recognition sequence
KSIDPKTGD

SEQ ID NO: 2866 - protein, 8 aa, Artificial Sequence
  Representative cyclic modulating agent based on Protocadherin cell adhesion recognition sequence
KFSIDPKD

SEQ ID NO: 2867 - protein, 9 aa, Artificial Sequence
  Representative cyclic modulating agent based on Protocadherin cell adhesion recognition sequence
KFSIDPKTD

SEQ ID NO: 2868 - protein, 10 aa, Artificial Sequence
  Representative cyclic modulating agent based on Protocadherin cell adhesion recognition sequence
KFSIDPKTGD

SEQ ID NO: 2869 - protein, 9 aa, Artificial Sequence
  Representative cyclic modulating agent based on Protocadherin cell adhesion recognition sequence
KLFSIDPKD

SEQ ID NO: 2870 - protein, 10 aa, Artificial Sequence
  Representative cyclic modulating agent based on Protocadherin cell adhesion recognition sequence
KLFSIDPKTD

SEQ ID NO: 2871 - protein, 11 aa, Artificial Sequence
  Representative cyclic modulating agent based on Protocadherin cell adhesion recognition sequence
KLFSIDPKTGD

SEQ ID NO: 2872 - protein, 5 aa, Artificial Sequence
  Representative cyclic modulating agent based on Protocadherin cell adhesion recognition sequence
KDPSD

SEQ ID NO: 2873 - protein, 6 aa, Artificial Sequence
  Representative cyclic modulating agent based on Protocadherin cell adhesion recognition sequence
KDPSSD

SEQ ID NO: 2874 - protein, 7 aa, Artificial Sequence
  Representative cyclic modulating agent based on Protocadherin cell adhesion recognition sequence
KDPSSGD

SEQ ID NO: 2875 - protein, 6 aa, Artificial Sequence
  Representative cyclic modulating agent based on Protocadherin cell adhesion recognition sequence
KIDPSD

SEQ ID NO: 2876 - protein, 7 aa, Artificial Sequence
  Representative cyclic modulating agent based on Protocadherin cell adhesion recognition sequence
KIDPSSD

SEQ ID NO: 2877 - protein, 8 aa, Artificial Sequence
  Representative cyclic modulating agent based on Protocadherin cell adhesion recognition sequence
KIDPSSGD

SEQ ID NO: 2878 - protein, 7 aa, Artificial Sequence
  Representative cyclic modulating agent based on Protocadherin cell adhesion recognition sequence
KEIDPSD

SEQ ID NO: 2879 - protein, 8 aa, Artificial Sequence
  Representative cyclic modulating agent based on Protocadherin cell adhesion recognition sequence
KEIDPSSD

SEQ ID NO: 2880 - protein, 9 aa, Artificial Sequence
  Representative cyclic modulating agent based on Protocadherin cell adhesion recognition sequence
KEIDPSSGD

SEQ ID NO: 2881 - protein, 8 aa, Artificial Sequence
  Representative cyclic modulating agent based on Protocadherin cell adhesion recognition sequence
KFEIDPSD

SEQ ID NO: 2882 - protein, 9 aa, Artificial Sequence
  Representative cyclic modulating agent based on Protocadherin cell adhesion recognition sequence
KFEIDPSSD

SEQ ID NO: 2883 - protein, 7 aa, Artificial Sequence
  Representative cyclic modulating agent based on Protocadherin cell adhesion recognition sequence
DINENTK

SEQ ID NO: 2884 - protein, 8 aa, Artificial Sequence
  Representative cyclic modulating agent based on Protocadherin cell adhesion recognition sequence
DIINENTK

SEQ ID NO: 2885 - protein, 9 aa, Artificial Sequence
  Representative cyclic modulating agent based on Protocadherin cell adhesion recognition sequence
DFIINENTK

SEQ ID NO: 2886 - protein, 10 aa, Artificial Sequence
  Representative cyclic modulating agent based on Protocadherin cell adhesion recognition sequence
KFEIDPSSGD

SEQ ID NO: 2887 - protein, 9 aa, Artificial Sequence
  Representative cyclic modulating agent based on Protocadherin cell adhesion recognition sequence
KLFEIDPSD

SEQ ID NO: 2888 - protein, 10 aa, Artificial Sequence
  Representative cyclic modulating agent based on Protocadherin cell adhesion recognition sequence
KLFEIDPSSD

SEQ ID NO: 2889 - protein, 11 aa, Artificial Sequence
  Representative cyclic modulating agent based on Protocadherin cell adhesion recognition sequence
KLFEIDPSSGD

SEQ ID NO: 2890 - protein, 5 aa, Artificial Sequence
  Representative cyclic modulating agent based on Protocadherin cell adhesion recognition sequence
KDLVE

SEQ ID NO: 2891 - protein, 6 aa, Artificial Sequence
  Representative cyclic modulating agent based on Protocadherin cell adhesion recognition sequence
KDLVTE

SEQ ID NO: 2892 - protein, 7 aa, Artificial Sequence
  Representative cyclic modulating agent based on Protocadherin cell adhesion recognition sequence
KDLVTGE

SEQ ID NO: 2893 - protein, 6 aa, Artificial Sequence
  Representative cyclic modulating agent based on Protocadherin cell adhesion recognition sequence
KLDLVE

SEQ ID NO: 2894 - protein, 7 aa, Artificial Sequence
  Representative cyclic modulating agent based on Protocadherin cell adhesion recognition sequence
KLDLVTE

SEQ ID NO: 2895 - protein, 8 aa, Artificial Sequence
  Representative cyclic modulating agent based on Protocadherin cell adhesion recognition sequence
KLDLVTGE

SEQ ID NO: 2896 - protein, 7 aa, Artificial Sequence
  Representative cyclic modulating agent based on Protocadherin cell adhesion recognition sequence
KALDLVE

SEQ ID NO: 2897 - protein, 8 aa, Artificial Sequence
  Representative cyclic modulating agent based on Protocadherin cell adhesion recognition sequence
KALDLVTE

SEQ ID NO: 2898 - protein, 9 aa, Artificial Sequence
  Representative cyclic modulating agent based on Protocadherin cell adhesion recognition sequence
KALDLVTGE

SEQ ID NO: 2899 - protein, 8 aa, Artificial Sequence
  Representative cyclic modulating agent based on Protocadherin cell adhesion recognition sequence
KFALDLVE

SEQ ID NO: 2900 - protein, 9 aa, Artificial Sequence
  Representative cyclic modulating agent based on Protocadherin cell adhesion recognition sequence
KFALDLVTE

SEQ ID NO: 2901 - protein, 10 aa, Artificial Sequence
  Representative cyclic modulating agent based on Protocadherin cell adhesion recognition sequence
KFALDLVTGE

SEQ ID NO: 2902 - protein, 9 aa, Artificial Sequence
  Representative cyclic modulating agent based on Protocadherin cell adhesion recognition sequence
KLFALDLVE

SEQ ID NO: 2903 - protein, 10 aa, Artificial Sequence
  Representative cyclic modulating agent based on Protocadherin cell adhesion recognition sequence
KLFALDLVTE

SEQ ID NO: 2904 - protein, 11 aa, Artificial Sequence
  Representative cyclic modulating agent based on Protocadherin cell adhesion recognition sequence
KLFALDLVTGE

SEQ ID NO: 2905 - protein, 5 aa, Artificial Sequence
  Representative cyclic modulating agent based on Protocadherin cell adhesion recognition sequence
KNRDE

SEQ ID NO: 2906 - protein, 6 aa, Artificial Sequence
  Representative cyclic modulating agent based on Protocadherin cell adhesion recognition sequence
KNRDNE

SEQ ID NO: 2907 - protein, 7 aa, Artificial Sequence
  Representative cyclic modulating agent based on Protocadherin cell adhesion recognition sequence
KNRDNGE

SEQ ID NO: 2908 - protein, 6 aa, Artificial Sequence
  Representative cyclic modulating agent based on Protocadherin cell adhesion recognition sequence
KINRDE

SEQ ID NO: 2909 - protein, 7 aa, Artificial Sequence
  Representative cyclic modulating agent based on Protocadherin cell adhesion recognition sequence
KINRDNE

SEQ ID NO: 2910 - protein, 8 aa, Artificial Sequence
  Representative cyclic modulating agent based on Protocadherin cell adhesion recognition sequence
KINRDNGE

SEQ ID NO: 2911 - protein, 7 aa, Artificial Sequence
  Representative cyclic modulating agent based on Protocadherin cell adhesion recognition sequence
KTINRDE

SEQ ID NO: 2912 - protein, 8 aa, Artificial Sequence
  Representative cyclic modulating agent based on Protocadherin cell adhesion recognition sequence
KTINRDNE

SEQ ID NO: 2913 - protein, 9 aa, Artificial Sequence
  Representative cyclic modulating agent based on Protocadherin cell adhesion recognition sequence
KTINRDNGE

SEQ ID NO: 2914 - protein, 8 aa, Artificial Sequence
  Representative cyclic modulating agent based on Protocadherin cell adhesion recognition sequence
KFTINRDE

SEQ ID NO: 2915 - protein, 9 aa, Artificial Sequence
  Representative cyclic modulating agent based on Protocadherin cell adhesion recognition sequence
KFTINRDNE

SEQ ID NO: 2916 - protein, 10 aa, Artificial Sequence
  Representative cyclic modulating agent based on Protocadherin cell adhesion recognition sequence
KFTINRDNGE

SEQ ID NO: 2917 - protein, 9 aa, Artificial Sequence
  Representative cyclic modulating agent based on Protocadherin cell adhesion recognition sequence
KYFTINRDE

SEQ ID NO: 2918 - protein, 10 aa, Artificial Sequence
  Representative cyclic modulating agent based on Protocadherin cell adhesion recognition sequence
KYFTINRDNE

SEQ ID NO: 2919 - protein, 11 aa, Artificial Sequence
  Representative cyclic modulating agent based on Protocadherin cell adhesion recognition sequence
KYFTINRDNGE

SEQ ID NO: 2920 - protein, 5 aa, Artificial Sequence
  Representative cyclic modulating agent based on Protocadherin cell adhesion recognition sequence
KDPKE

SEQ ID NO: 2921 - protein, 6 aa, Artificial Sequence
  Representative cyclic modulating agent based on Protocadherin cell adhesion recognition sequence
KDPKTE

SEQ ID NO: 2922 - protein, 7 aa, Artificial Sequence
  Representative cyclic modulating agent based on Protocadherin cell adhesion recognition sequence
KDPKTGE

SEQ ID NO: 2923 - protein, 6 aa, Artificial Sequence
  Representative cyclic modulating agent based on Protocadherin cell adhesion recognition sequence
KIDPKE

SEQ ID NO: 2924 - protein, 7 aa, Artificial Sequence
  Representative cyclic modulating agent based on Protocadherin cell adhesion recognition sequence
KIDPKTE

SEQ ID NO: 2925 - protein, 8 aa, Artificial Sequence
  Representative cyclic modulating agent based on Protocadherin cell adhesion recognition sequence
KIDPKTGE

SEQ ID NO: 2926 - protein, 7 aa, Artificial Sequence
  Representative cyclic modulating agent based on Protocadherin cell adhesion recognition sequence
KSIDPKE

SEQ ID NO: 2927 - protein, 8 aa, Artificial Sequence
  Representative cyclic modulating agent based on Protocadherin cell adhesion recognition sequence
KSIDPKTE

SEQ ID NO: 2928 - protein, 9 aa, Artificial Sequence
  Representative cyclic modulating agent based on Protocadherin cell adhesion recognition sequence
KSIDPKTGE

SEQ ID NO: 2929 - protein, 8 aa, Artificial Sequence
  Representative cyclic modulating agent based on Protocadherin cell adhesion recognition sequence
KFSIDPKE

SEQ ID NO: 2930 - protein, 9 aa, Artificial Sequence
  Representative cyclic modulating agent based on Protocadherin cell adhesion recognition sequence
KFSIDPKTE

SEQ ID NO: 2931 - protein, 10 aa, Artificial Sequence
  Representative cyclic modulating agent based on Protocadherin cell adhesion recognition sequence
KFSIDPKTGE

SEQ ID NO: 2932 - protein, 9 aa, Artificial Sequence
  Representative cyclic modulating agent based on Protocadherin cell adhesion recognition sequence
KLFSIDPKE

SEQ ID NO: 2933 - protein, 10 aa, Artificial Sequence
  Representative cyclic modulating agent based on Protocadherin cell adhesion recognition sequence
KLFSIDPKTE

SEQ ID NO: 2934 - protein, 11 aa, Artificial Sequence
  Representative cyclic modulating agent based on Protocadherin cell adhesion recognition sequence
KLFSIDPKTGE

SEQ ID NO: 2935 - protein, 5 aa, Artificial Sequence
  Representative cyclic modulating agent based on Protocadherin cell adhesion recognition sequence
KDPSE

SEQ ID NO: 2936 - protein, 6 aa, Artificial Sequence
  Representative cyclic modulating agent based on Protocadherin cell adhesion recognition sequence
KDPSSE

SEQ ID NO: 2937 - protein, 7 aa, Artificial Sequence
  Representative cyclic modulating agent based on Protocadherin cell adhesion recognition sequence
KDPSSGE

SEQ ID NO: 2938 - protein, 6 aa, Artificial Sequence
  Representative cyclic modulating agent based on Protocadherin cell adhesion recognition sequence
KIDPSE

SEQ ID NO: 2939 - protein, 7 aa, Artificial Sequence
  Representative cyclic modulating agent based on Protocadherin cell adhesion recognition sequence
KIDPSSE

SEQ ID NO: 2940 - protein, 8 aa, Artificial Sequence
  Representative cyclic modulating agent based on Protocadherin cell adhesion recognition sequence
KIDPSSGE

SEQ ID NO: 2941 - protein, 7 aa, Artificial Sequence
  Representative cyclic modulating agent based on Protocadherin cell adhesion recognition sequence
KEIDPSE

SEQ ID NO: 2942 - protein, 8 aa, Artificial Sequence
  Representative cyclic modulating agent based on Protocadherin cell adhesion recognition sequence
KEIDPSSE

SEQ ID NO: 2943 - protein, 9 aa, Artificial Sequence
  Representative cyclic modulating agent based on Protocadherin cell adhesion recognition sequence
KEIDPSSGE

SEQ ID NO: 2944 - protein, 8 aa, Artificial Sequence
  Representative cyclic modulating agent based on Protocadherin cell adhesion recognition sequence
KFEIDPSE

SEQ ID NO: 2945 - protein, 9 aa, Artificial Sequence
  Representative cyclic modulating agent based on Protocadherin cell adhesion recognition sequence
KFEIDPSSE

SEQ ID NO: 2946 - protein, 10 aa, Artificial Sequence
  Representative cyclic modulating agent based on Protocadherin cell adhesion recognition sequence
DLFIINENTK

SEQ ID NO: 2947 - protein, 7 aa, Artificial Sequence
  Representative cyclic modulating agent based on Protocadherin cell adhesion recognition sequence
DNENTGK

SEQ ID NO: 2948 - protein, 10 aa, Artificial Sequence
  Representative cyclic modulating agent based on Protocadherin cell adhesion recognition sequence
DINENTHEGK

SEQ ID NO: 2949 - protein, 10 aa, Artificial Sequence
  Representative cyclic modulating agent based on Protocadherin cell adhesion recognition sequence
KFEIDPSSGE

SEQ ID NO: 2950 - protein, 9 aa, Artificial Sequence
  Representative cyclic modulating agent based on Protocadherin cell adhesion recognition sequence
KLFEIDPSE

SEQ ID NO: 2951 - protein, 10 aa, Artificial Sequence
  Representative cyclic modulating agent based on Protocadherin cell adhesion recognition sequence
KLFEIDPSSE

SEQ ID NO: 2952 - protein, 11 aa, Artificial Sequence
  Representative cyclic modulating agent based on Protocadherin cell adhesion recognition sequence
KLFEIDPSSGE

SEQ ID NO: 2953 - protein, 5 aa, Artificial Sequence
  Representative cyclic modulating agent based on Protocadherin cell adhesion recognition sequence
DDLVK

SEQ ID NO: 2954 - protein, 6 aa, Artificial Sequence
  Representative cyclic modulating agent based on Protocadherin cell adhesion recognition sequence
DDLVTK

SEQ ID NO: 2955 - protein, 7 aa, Artificial Sequence
  Representative cyclic modulating agent based on Protocadherin cell adhesion recognition sequence
DDLVTGK

SEQ ID NO: 2956 - protein, 6 aa, Artificial Sequence
  Representative cyclic modulating agent based on Protocadherin cell adhesion recognition sequence
DLDLVK

SEQ ID NO: 2957 - protein, 7 aa, Artificial Sequence
  Representative cyclic modulating agent based on Protocadherin cell adhesion recognition sequence
DLDLVTK

SEQ ID NO: 2958 - protein, 8 aa, Artificial Sequence
  Representative cyclic modulating agent based on Protocadherin cell adhesion recognition sequence
DLDLVTGK

SEQ ID NO: 2959 - protein, 7 aa, Artificial Sequence
  Representative cyclic modulating agent based on Protocadherin cell adhesion recognition sequence
DALDLVK

SEQ ID NO: 2960 - protein, 8 aa, Artificial Sequence
  Representative cyclic modulating agent based on Protocadherin cell adhesion recognition sequence
DALDLVTK

SEQ ID NO: 2961 - protein, 9 aa, Artificial Sequence
  Representative cyclic modulating agent based on Protocadherin cell adhesion recognition sequence
DALDLVTGK

SEQ ID NO: 2962 - protein, 8 aa, Artificial Sequence
  Representative cyclic modulating agent based on Protocadherin cell adhesion recognition sequence
DFALDLVK

SEQ ID NO: 2963 - protein, 9 aa, Artificial Sequence
  Representative cyclic modulating agent based on Protocadherin cell adhesion recognition sequence
DFALDLVTK

SEQ ID NO: 2964 - protein, 10 aa, Artificial Sequence
  Representative cyclic modulating agent based on Protocadherin cell adhesion recognition sequence
DFALDLVTGK

SEQ ID NO: 2965 - protein, 9 aa, Artificial Sequence
  Representative cyclic modulating agent based on Protocadherin cell adhesion recognition sequence
DLFALDLVK

SEQ ID NO: 2966 - protein, 10 aa, Artificial Sequence
  Representative cyclic modulating agent based on Protocadherin cell adhesion recognition sequence
DLFALDLVTK

SEQ ID NO: 2967 - protein, 11 aa, Artificial Sequence
  Representative cyclic modulating agent based on Protocadherin cell adhesion recognition sequence
DLFALDLVTGK

SEQ ID NO: 2968 - protein, 5 aa, Artificial Sequence
  Representative cyclic modulating agent based on Protocadherin cell adhesion recognition sequence
DNRDK

SEQ ID NO: 2969 - protein, 6 aa, Artificial Sequence
  Representative cyclic modulating agent based on Protocadherin cell adhesion recognition sequence
DNRDNK

SEQ ID NO: 2970 - protein, 7 aa, Artificial Sequence
  Representative cyclic modulating agent based on Protocadherin cell adhesion recognition sequence
DNRDNGK

SEQ ID NO: 2971 - protein, 6 aa, Artificial Sequence
  Representative cyclic modulating agent based on Protocadherin cell adhesion recognition sequence
DINRDK

SEQ ID NO: 2972 - protein, 7 aa, Artificial Sequence
  Representative cyclic modulating agent based on Protocadherin cell adhesion recognition sequence
DINRDNK

SEQ ID NO: 2973 - protein, 8 aa, Artificial Sequence
  Representative cyclic modulating agent based on Protocadherin cell adhesion recognition sequence
DINRDNGK

SEQ ID NO: 2974 - protein, 7 aa, Artificial Sequence
  Representative cyclic modulating agent based on Protocadherin cell adhesion recognition sequence
DTINRDK

SEQ ID NO: 2975 - protein, 8 aa, Artificial Sequence
  Representative cyclic modulating agent based on Protocadherin cell adhesion recognition sequence
DTINRDNK

SEQ ID NO: 2976 - protein, 9 aa, Artificial Sequence
  Representative cyclic modulating agent based on Protocadherin cell adhesion recognition sequence
DTINRDNGK

SEQ ID NO: 2977 - protein, 8 aa, Artificial Sequence
  Representative cyclic modulating agent based on Protocadherin cell adhesion recognition sequence
DFTINRDK

SEQ ID NO: 2978 - protein, 9 aa, Artificial Sequence
  Representative cyclic modulating agent based on Protocadherin cell adhesion recognition sequence
DFTINRDNK

SEQ ID NO: 2979 - protein, 10 aa, Artificial Sequence
  Representative cyclic modulating agent based on Protocadherin cell adhesion recognition sequence
DFTINRDNGK

SEQ ID NO: 2980 - protein, 9 aa, Artificial Sequence
  Representative cyclic modulating agent based on Protocadherin cell adhesion recognition sequence
DYFTINRDK

SEQ ID NO: 2981 - protein, 10 aa, Artificial Sequence
  Representative cyclic modulating agent based on Protocadherin cell adhesion recognition sequence
DYFTINRDNK

SEQ ID NO: 2982 - protein, 11 aa, Artificial Sequence
  Representative cyclic modulating agent based on Protocadherin cell adhesion recognition sequence
DYFTINRDNGK

SEQ ID NO: 2983 - protein, 5 aa, Artificial Sequence
  Representative cyclic modulating agent based on Protocadherin cell adhesion recognition sequence
DDPKK

SEQ ID NO: 2984 - protein, 6 aa, Artificial Sequence
  Representative cyclic modulating agent based on Protocadherin cell adhesion recognition sequence
DDPKTK

SEQ ID NO: 2985 - protein, 7 aa, Artificial Sequence
  Representative cyclic modulating agent based on Protocadherin cell adhesion recognition sequence
DDPKTGK

SEQ ID NO: 2986 - protein, 6 aa, Artificial Sequence
  Representative cyclic modulating agent based on Protocadherin cell adhesion recognition sequence
DIDPKK

SEQ ID NO: 2987 - protein, 7 aa, Artificial Sequence
  Representative cyclic modulating agent based on Protocadherin cell adhesion recognition sequence
DIDPKTK

SEQ ID NO: 2988 - protein, 8 aa, Artificial Sequence
  Representative cyclic modulating agent based on Protocadherin cell adhesion recognition sequence
DIDPKTGD

SEQ ID NO: 2989 - protein, 7 aa, Artificial Sequence
  Representative cyclic modulating agent based on Protocadherin cell adhesion recognition sequence
DSIDPKK

SEQ ID NO: 2990 - protein, 8 aa, Artificial Sequence
  Representative cyclic modulating agent based on Protocadherin cell adhesion recognition sequence
DSIDPKTK

SEQ ID NO: 2991 - protein, 9 aa, Artificial Sequence
  Representative cyclic modulating agent based on Protocadherin cell adhesion recognition sequence
DSIDPKTGK

SEQ ID NO: 2992 - protein, 8 aa, Artificial Sequence
  Representative cyclic modulating agent based on Protocadherin cell adhesion recognition sequence
DFSIDPKK

SEQ ID NO: 2993 - protein, 9 aa, Artificial Sequence
  Representative cyclic modulating agent based on Protocadherin cell adhesion recognition sequence
DFSIDPKTK

SEQ ID NO: 2994 - protein, 10 aa, Artificial Sequence
  Representative cyclic modulating agent based on Protocadherin cell adhesion recognition sequence
DFSIDPKTGK

SEQ ID NO: 2995 - protein, 9 aa, Artificial Sequence
  Representative cyclic modulating agent based on Protocadherin cell adhesion recognition sequence
DLFSIDPKK

SEQ ID NO: 2996 - protein, 10 aa, Artificial Sequence
  Representative cyclic modulating agent based on Protocadherin cell adhesion recognition sequence
DLFSIDPKTK

SEQ ID NO: 2997 - protein, 11 aa, Artificial Sequence
  Representative cyclic modulating agent based on Protocadherin cell adhesion recognition sequence
DLFSIDPKTGK

SEQ ID NO: 2998 - protein, 5 aa, Artificial Sequence
  Representative cyclic modulating agent based on Protocadherin cell adhesion recognition sequence
DDPSK

SEQ ID NO: 2999 - protein, 6 aa, Artificial Sequence
  Representative cyclic modulating agent based on Protocadherin cell adhesion recognition sequence
DDPSSK

SEQ ID NO: 3000 - protein, 7 aa, Artificial Sequence
  Representative cyclic modulating agent based on Protocadherin cell adhesion recognition sequence
DDPSSGK

SEQ ID NO: 3001 - protein, 6 aa, Artificial Sequence
  Representative cyclic modulating agent based on Protocadherin cell adhesion recognition sequence
DIDPSK

SEQ ID NO: 3002 - protein, 7 aa, Artificial Sequence
  Representative cyclic modulating agent based on Protocadherin cell adhesion recognition sequence
DIDPSSK

SEQ ID NO: 3003 - protein, 8 aa, Artificial Sequence
  Representative cyclic modulating agent based on Protocadherin cell adhesion recognition sequence
DIDPSSGK

SEQ ID NO: 3004 - protein, 7 aa, Artificial Sequence
  Representative cyclic modulating agent based on Protocadherin cell adhesion recognition sequence
DEIDPSK

SEQ ID NO: 3005 - protein, 8 aa, Artificial Sequence
  Representative cyclic modulating agent based on Protocadherin cell adhesion recognition sequence
DEIDPSSK

SEQ ID NO: 3006 - protein, 9 aa, Artificial Sequence
  Representative cyclic modulating agent based on Protocadherin cell adhesion recognition sequence
DEIDPSSGK

SEQ ID NO: 3007 - protein, 8 aa, Artificial Sequence
  Representative cyclic modulating agent based on Protocadherin cell adhesion recognition sequence
DFEIDPSK

SEQ ID NO: 3008 - protein, 9 aa, Artificial Sequence
  Representative cyclic modulating agent based on Protocadherin cell adhesion recognition sequence
DFEIDPSSK

SEQ ID NO: 3009 - protein, 9 aa, Artificial Sequence
  Representative cyclic modulating agent based on Protocadherin cell adhesion recognition sequence
DIINENTGK

SEQ ID NO: 3010 - protein, 10 aa, Artificial Sequence
  Representative cyclic modulating agent based on Protocadherin cell adhesion recognition sequence
DFIINENTGK

SEQ ID NO: 3011 - protein, 11 aa, Artificial Sequence
  Representative cyclic modulating agent based on Protocadherin cell adhesion recognition sequence
DLFIINENTGK

SEQ ID NO: 3012 - protein, 10 aa, Artificial Sequence
  Representative cyclic modulating agent based on Protocadherin cell adhesion recognition sequence
DFEIDPSSGK

SEQ ID NO: 3013 - protein, 9 aa, Artificial Sequence
  Representative cyclic modulating agent based on Protocadherin cell adhesion recognition sequence
DLFEIDPSK

SEQ ID NO: 3014 - protein, 10 aa, Artificial Sequence
  Representative cyclic modulating agent based on Protocadherin cell adhesion recognition sequence
DLFEIDPSSK

SEQ ID NO: 3015 - protein, 11 aa, Artificial Sequence
  Representative cyclic modulating agent based on Protocadherin cell adhesion recognition sequence
DLFEIDPSSGK

SEQ ID NO: 3016 - protein, 5 aa, Artificial Sequence
  Representative cyclic modulating agent based on Protocadherin cell adhesion recognition sequence
DLVTG

SEQ ID NO: 3017 - protein, 5 aa, Artificial Sequence
  Representative cyclic modulating agent based on Protocadherin cell adhesion recognition sequence
LDLVT

SEQ ID NO: 3018 - protein, 6 aa, Artificial Sequence
  Representative cyclic modulating agent based on Protocadherin cell adhesion recognition sequence
LDLVTG

SEQ ID NO: 3019 - protein, 5 aa, Artificial Sequence
  Representative cyclic modulating agent based on Protocadherin cell adhesion recognition sequence
ALDLV

SEQ ID NO: 3020 - protein, 6 aa, Artificial Sequence
  Representative cyclic modulating agent based on Protocadherin cell adhesion recognition sequence
ALDLVT

SEQ ID NO: 3021 - protein, 7 aa, Artificial Sequence
  Representative cyclic modulating agent based on Protocadherin cell adhesion recognition sequence
ALDLVTG

SEQ ID NO: 3022 - protein, 6 aa, Artificial Sequence
  Representative cyclic modulating agent based on Protocadherin cell adhesion recognition sequence
FALDLV

SEQ ID NO: 3023 - protein, 8 aa, Artificial Sequence
  Representative cyclic modulating agent based on Protocadherin cell adhesion recognition sequence
FALDLVTC

SEQ ID NO: 3024 - protein, 8 aa, Artificial Sequence
  Representative cyclic modulating agent based on Protocadherin cell adhesion recognition sequence
FALDLVTG

SEQ ID NO: 3025 - protein, 7 aa, Artificial Sequence
  Representative cyclic modulating agent based on Protocadherin cell adhesion recognition sequence
LFALDLV

SEQ ID NO: 3026 - protein, 8 aa, Artificial Sequence
  Representative cyclic modulating agent based on Protocadherin cell adhesion recognition sequence
LFALDLVT

SEQ ID NO: 3027 - protein, 9 aa, Artificial Sequence
  Representative cyclic modulating agent based on Protocadherin cell adhesion recognition sequence
LFALDLVTG

SEQ ID NO: 3028 - protein, 5 aa, Artificial Sequence
  Representative cyclic modulating agent based on Protocadherin cell adhesion recognition sequence
NRDNG

SEQ ID NO: 3029 - protein, 5 aa, Artificial Sequence
  Representative cyclic modulating agent based on Protocadherin cell adhesion recognition sequence
INRDN

SEQ ID NO: 3030 - protein, 6 aa, Artificial Sequence
  Representative cyclic modulating agent based on Protocadherin cell adhesion recognition sequence
INRDNG

SEQ ID NO: 3031 - protein, 5 aa, Artificial Sequence
  Representative cyclic modulating agent based on Protocadherin cell adhesion recognition sequence
TINRD

SEQ ID NO: 3032 - protein, 6 aa, Artificial Sequence
  Representative cyclic modulating agent based on Protocadherin cell adhesion recognition sequence
TINRDN

SEQ ID NO: 3033 - protein, 7 aa, Artificial Sequence
  Representative cyclic modulating agent based on Protocadherin cell adhesion recognition sequence
TINRDNG

SEQ ID NO: 3034 - protein, 6 aa, Artificial Sequence
  Representative cyclic modulating agent based on Protocadherin cell adhesion recognition sequence
FTINRD

SEQ ID NO: 3035 - protein, 7 aa, Artificial Sequence
  Representative cyclic modulating agent based on Protocadherin cell adhesion recognition sequence
FTINRDN

SEQ ID NO: 3036 - protein, 8 aa, Artificial Sequence
  Representative cyclic modulating agent based on Protocadherin cell adhesion recognition sequence
FTINRDNG

SEQ ID NO: 3037 - protein, 7 aa, Artificial Sequence
  Representative cyclic modulating agent based on Protocadherin cell adhesion recognition sequence
YFTINRD

SEQ ID NO: 3038 - protein, 8 aa, Artificial Sequence
  Representative cyclic modulating agent based on Protocadherin cell adhesion recognition sequence
YFTINRDN

SEQ ID NO: 3039 - protein, 9 aa, Artificial Sequence
  Representative cyclic modulating agent based on Protocadherin cell adhesion recognition sequence
YFTINRDNG

SEQ ID NO: 3040 - protein, 5 aa, Artificial Sequence
  Representative cyclic modulating agent based on Protocadherin cell adhesion recognition sequence
DPKTG

SEQ ID NO: 3041 - protein, 5 aa, Artificial Sequence
  Representative cyclic modulating agent based on Protocadherin cell adhesion recognition sequence
IDPKT

SEQ ID NO: 3042 - protein, 6 aa, Artificial Sequence
  Representative cyclic modulating agent based on Protocadherin cell adhesion recognition sequence
IDPKTG

SEQ ID NO: 3043 - protein, 5 aa, Artificial Sequence
  Representative cyclic modulating agent based on Protocadherin cell adhesion recognition sequence
SIDPK

SEQ ID NO: 3044 - protein, 6 aa, Artificial Sequence
  Representative cyclic modulating agent based on Protocadherin cell adhesion recognition sequence
SIDPKT

SEQ ID NO: 3045 - protein, 7 aa, Artificial Sequence
  Representative cyclic modulating agent based on Protocadherin cell adhesion recognition sequence
SIDPKTG

SEQ ID NO: 3046 - protein, 6 aa, Artificial Sequence
  Representative cyclic modulating agent based on Protocadherin cell adhesion recognition sequence
FSIDPK

SEQ ID NO: 3047 - protein, 7 aa, Artificial Sequence
  Representative cyclic modulating agent based on Protocadherin cell adhesion recognition sequence
FSIDPKT

SEQ ID NO: 3048 - protein, 8 aa, Artificial Sequence
  Representative cyclic modulating agent based on Protocadherin cell adhesion recognition sequence
FSIDPKTG

SEQ ID NO: 3049 - protein, 7 aa, Artificial Sequence
  Representative cyclic modulating agent based on Protocadherin cell adhesion recognition sequence
LFSIDPK

SEQ ID NO: 3050 - protein, 8 aa, Artificial Sequence
  Representative cyclic modulating agent based on Protocadherin cell adhesion recognition sequence
LFSIDPKT

SEQ ID NO: 3051 - protein, 9 aa, Artificial Sequence
  Representative cyclic modulating agent based on Protocadherin cell adhesion recognition sequence
LFSIDPKTG

SEQ ID NO: 3052 - protein, 5 aa, Artificial Sequence
  Representative cyclic modulating agent based on Protocadherin cell adhesion recognition sequence
DPSSG

SEQ ID NO: 3053 - protein, 5 aa, Artificial Sequence
  Representative cyclic modulating agent based on Protocadherin cell adhesion recognition sequence
IDPSS

SEQ ID NO: 3054 - protein, 6 aa, Artificial Sequence
  Representative cyclic modulating agent based on Protocadherin cell adhesion recognition sequence
IDPSSG

SEQ ID NO: 3055 - protein, 6 aa, Artificial Sequence
  Representative cyclic modulating agent based on Protocadherin cell adhesion recognition sequence
ENENTK

SEQ ID NO: 3056 - protein, 6 aa, Artificial Sequence
  Representative cyclic modulating agent based on Protocadherin cell adhesion recognition sequence
EIDPSS

SEQ ID NO: 3057 - protein, 7 aa, Artificial Sequence
  Representative cyclic modulating agent based on Protocadherin cell adhesion recognition sequence
EIDPSSG

SEQ ID NO: 3058 - protein, 6 aa, Artificial Sequence
  Representative cyclic modulating agent based on Protocadherin cell adhesion recognition sequence
FEIDPS

SEQ ID NO: 3059 - protein, 7 aa, Artificial Sequence
  Representative cyclic modulating agent based on Protocadherin cell adhesion recognition sequence
FEIDPSS

SEQ ID NO: 3060 - protein, 7 aa, Artificial Sequence
  Representative cyclic modulating agent based on Protocadherin cell adhesion recognition sequence
EIDPSSG

SEQ ID NO: 3061 - protein, 6 aa, Artificial Sequence
  Representative cyclic modulating agent based on Protocadherin cell adhesion recognition sequence
FEIDPS

SEQ ID NO: 3062 - protein, 8 aa, Artificial Sequence
  Representative cyclic modulating agent based on Protocadherin cell adhesion recognition sequence
FEIDPSSG

SEQ ID NO: 3063 - protein, 7 aa, Artificial Sequence
  Representative cyclic modulating agent based on Protocadherin cell adhesion recognition sequence
LFEIDPS

SEQ ID NO: 3064 - protein, 8 aa, Artificial Sequence
  Representative cyclic modulating agent based on Protocadherin cell adhesion recognition sequence
LFEIDPSS

SEQ ID NO: 3065 - protein, 9 aa, Artificial Sequence
  Representative cyclic modulating agent based on Protocadherin cell adhesion recognition sequence
LFEIDPSSG

SEQ ID NO: 3066 - protein, 5 aa, Artificial Sequence
  Representative cyclic modulating agent based on Desmoglein cell adhesion recognition sequence
CNQKC

SEQ ID NO: 3067 - protein, 6 aa, Artificial Sequence
  Representative cyclic modulating agent based on Desmoglein cell adhesion recognition sequence
CNQKTC

SEQ ID NO: 3068 - protein, 7 aa, Artificial Sequence
  Representative cyclic modulating agent based on Desmoglein cell adhesion recognition sequence
CNQKTGC

SEQ ID NO: 3069 - protein, 6 aa, Artificial Sequence
  Representative cyclic modulating agent based on Desmoglein cell adhesion recognition sequence
CINQKC

SEQ ID NO: 3070 - protein, 7 aa, Artificial Sequence
  Representative cyclic modulating agent based on Desmoglein cell adhesion recognition sequence
CINQKTC

SEQ ID NO: 3071 - protein, 8 aa, Artificial Sequence
  Representative cyclic modulating agent based on Desmoglein cell adhesion recognition sequence
CINQKTGC

SEQ ID NO: 3072 - protein, 7 aa, Artificial Sequence
  Representative cyclic modulating agent based on Desmoglein cell adhesion recognition sequence
CVINQKC

SEQ ID NO: 3073 - protein, 8 aa, Artificial Sequence
  Representative cyclic modulating agent based on Desmoglein cell adhesion recognition sequence
CVINQKTC

SEQ ID NO: 3074 - protein, 9 aa, Artificial Sequence
  Representative cyclic modulating agent based on Desmoglein cell adhesion recognition sequence
CVINQKTGC

SEQ ID NO: 3075 - protein, 8 aa, Artificial Sequence
  Representative cyclic modulating agent based on Desmoglein cell adhesion recognition sequence
CFVINQKC

SEQ ID NO: 3076 - protein, 9 aa, Artificial Sequence
  Representative cyclic modulating agent based on Desmoglein cell adhesion recognition sequence
CFVINQKTC

SEQ ID NO: 3077 - protein, 10 aa, Artificial Sequence
  Representative cyclic modulating agent based on Desmoglein cell adhesion recognition sequence
CFVINQKTGC

SEQ ID NO: 3078 - protein, 9 aa, Artificial Sequence
  Representative cyclic modulating agent based on Desmoglein cell adhesion recognition sequence
CIFVINQKC

SEQ ID NO: 3079 - protein, 10 aa, Artificial Sequence
  Representative cyclic modulating agent based on Desmoglein cell adhesion recognition sequence
CIFVINQKTC

SEQ ID NO: 3080 - protein, 11 aa, Artificial Sequence
  Representative cyclic modulating agent based on Desmoglein cell adhesion recognition sequence
CIFVINQKTGC

SEQ ID NO: 3081 - protein, 5 aa, Artificial Sequence
  Representative cyclic modulating agent based on Desmoglein cell adhesion recognition sequence
CNRNC

SEQ ID NO: 3082 - protein, 6 aa, Artificial Sequence
  Representative cyclic modulating agent based on Desmoglein cell adhesion recognition sequence
CNRNTC

SEQ ID NO: 3083 - protein, 7 aa, Artificial Sequence
  Representative cyclic modulating agent based on Desmoglein cell adhesion recognition sequence
CNRNTGC

SEQ ID NO: 3084 - protein, 6 aa, Artificial Sequence
  Representative cyclic modulating agent based on Desmoglein cell adhesion recognition sequence
CINRNC

SEQ ID NO: 3085 - protein, 7 aa, Artificial Sequence
  Representative cyclic modulating agent based on Desmoglein cell adhesion recognition sequence
CINRNTC

SEQ ID NO: 3086 - protein, 8 aa, Artificial Sequence
  Representative cyclic modulating agent based on Desmoglein cell adhesion recognition sequence
CINRNTGC

SEQ ID NO: 3087 - protein, 7 aa, Artificial Sequence
  Representative cyclic modulating agent based on Desmoglein cell adhesion recognition sequence
CIINRNC

SEQ ID NO: 3088 - protein, 8 aa, Artificial Sequence
  Representative cyclic modulating agent based on Desmoglein cell adhesion recognition sequence
CIINRNTC

SEQ ID NO: 3089 - protein, 9 aa, Artificial Sequence
  Representative cyclic modulating agent based on Desmoglein cell adhesion recognition sequence
CIINRNTGC

SEQ ID NO: 3090 - protein, 8 aa, Artificial Sequence
  Representative cyclic modulating agent based on Desmoglein cell adhesion recognition sequence
CFIINRNC

SEQ ID NO: 3091 - protein, 9 aa, Artificial Sequence
  Representative cyclic modulating agent based on Desmoglein cell adhesion recognition sequence
CFIINRNTC

SEQ ID NO: 3092 - protein, 10 aa, Artificial Sequence
  Representative cyclic modulating agent based on Desmoglein cell adhesion recognition sequence
CFIINRNTGC

SEQ ID NO: 3093 - protein, 9 aa, Artificial Sequence
  Representative cyclic modulating agent based on Desmoglein cell adhesion recognition sequence
CMFIINRNC

SEQ ID NO: 3094 - protein, 10 aa, Artificial Sequence
  Representative cyclic modulating agent based on Desmoglein cell adhesion recognition sequence
CMFIINRNTC

SEQ ID NO: 3095 - protein, 11 aa, Artificial Sequence
  Representative cyclic modulating agent based on Desmoglein cell adhesion recognition sequence
CMFIINRNTGC

SEQ ID NO: 3096 - protein, 5 aa, Artificial Sequence
  Representative cyclic modulating agent based on Desmoglein cell adhesion recognition sequence
CNKDC

SEQ ID NO: 3097 - protein, 6 aa, Artificial Sequence
  Representative cyclic modulating agent based on Desmoglein cell adhesion recognition sequence
CNKDTC

SEQ ID NO: 3098 - protein, 7 aa, Artificial Sequence
  Representative cyclic modulating agent based on Desmoglein cell adhesion recognition sequence
CNKDTGC

SEQ ID NO: 3099 - protein, 6 aa, Artificial Sequence
  Representative cyclic modulating agent based on Desmoglein cell adhesion recognition sequence
CLNKDC

SEQ ID NO: 3100 - protein, 7 aa, Artificial Sequence
  Representative cyclic modulating agent based on Desmoglein cell adhesion recognition sequence
CLNKDTC

SEQ ID NO: 3101 - protein, 8 aa, Artificial Sequence
  Representative cyclic modulating agent based on Desmoglein cell adhesion recognition sequence
CLNKDTGC

SEQ ID NO: 3102 - protein, 7 aa, Artificial Sequence
  Representative cyclic modulating agent based on Desmoglein cell adhesion recognition sequence
CYLNKDC

SEQ ID NO: 3103 - protein, 8 aa, Artificial Sequence
  Representative cyclic modulating agent based on Desmoglein cell adhesion recognition sequence
CYLNKDTC

SEQ ID NO: 3104 - protein, 9 aa, Artificial Sequence
  Representative cyclic modulating agent based on Desmoglein cell adhesion recognition sequence
CYLNKDTGC

SEQ ID NO: 3105 - protein, 8 aa, Artificial Sequence
  Representative cyclic modulating agent based on Desmoglein cell adhesion recognition sequence
CFYLNKDC

SEQ ID NO: 3106 - protein, 9 aa, Artificial Sequence
  Representative cyclic modulating agent based on Desmoglein cell adhesion recognition sequence
CFYLNKDTC

SEQ ID NO: 3107 - protein, 10 aa, Artificial Sequence
  Representative cyclic modulating agent based on Desmoglein cell adhesion recognition sequence
CFYLNKDTGC

SEQ ID NO: 3108 - protein, 9 aa, Artificial Sequence
  Representative cyclic modulating agent based on Desmoglein cell adhesion recognition sequence
CVFYLNKDC

SEQ ID NO: 3109 - protein, 10 aa, Artificial Sequence
  Representative cyclic modulating agent based on Desmoglein cell adhesion recognition sequence
CVFYLNKDTC

SEQ ID NO: 3110 - protein, 11 aa, Artificial Sequence
  Representative cyclic modulating agent based on Desmoglein cell adhesion recognition sequence
CVFYLNKDTGC

SEQ ID NO: 3111 - protein, 5 aa, Artificial Sequence
  Representative cyclic modulating agent based on Desmoglein cell adhesion recognition sequence
ENQKK

SEQ ID NO: 3112 - protein, 6 aa, Artificial Sequence
  Representative cyclic modulating agent based on Desmoglein cell adhesion recognition sequence
ENQKTK

SEQ ID NO: 3113 - protein, 7 aa, Artificial Sequence
  Representative cyclic modulating agent based on Desmoglein cell adhesion recognition sequence
ENQKTGK

SEQ ID NO: 3114 - protein, 6 aa, Artificial Sequence
  Representative cyclic modulating agent based on Desmoglein cell adhesion recognition sequence
EINQKK

SEQ ID NO: 3115 - protein, 7 aa, Artificial Sequence
  Representative cyclic modulating agent based on Desmoglein cell adhesion recognition sequence
EINQKTK

SEQ ID NO: 3116 - protein, 8 aa, Artificial Sequence
  Representative cyclic modulating agent based on Desmoglein cell adhesion recognition sequence
EINQKTGK

SEQ ID NO: 3117 - protein, 7 aa, Artificial Sequence
  Representative cyclic modulating agent based on Desmoglein cell adhesion recognition sequence
EVINQKK

SEQ ID NO: 3118 - protein, 8 aa, Artificial Sequence
  Representative cyclic modulating agent based on Desmoglein cell adhesion recognition sequence
EVINQKTK

SEQ ID NO: 3119 - protein, 9 aa, Artificial Sequence
  Representative cyclic modulating agent based on Desmoglein cell adhesion recognition sequence
EVINQKTGK

SEQ ID NO: 3120 - protein, 8 aa, Artificial Sequence
  Representative cyclic modulating agent based on Desmoglein cell adhesion recognition sequence
EFVINQKK

SEQ ID NO: 3121 - protein, 9 aa, Artificial Sequence
  Representative cyclic modulating agent based on Desmoglein cell adhesion recognition sequence
EFVINQKTK

SEQ ID NO: 3122 - protein, 10 aa, Artificial Sequence
  Representative cyclic modulating agent based on Desmoglein cell adhesion recognition sequence
EFVINQKTGK

SEQ ID NO: 3123 - protein, 9 aa, Artificial Sequence
  Representative cyclic modulating agent based on Desmoglein cell adhesion recognition sequence
EIFVINQKK

SEQ ID NO: 3124 - protein, 10 aa, Artificial Sequence
  Representative cyclic modulating agent based on Desmoglein cell adhesion recognition sequence
EIFVINQKTK

SEQ ID NO: 3125 - protein, 11 aa, Artificial Sequence
  Representative cyclic modulating agent based on Desmoglein cell adhesion recognition sequence
EIFVINQKTGK

SEQ ID NO: 3126 - protein, 5 aa, Artificial Sequence
  Representative cyclic modulating agent based on Desmoglein cell adhesion recognition sequence
ENRNK

SEQ ID NO: 3127 - protein, 6 aa, Artificial Sequence
  Representative cyclic modulating agent based on Desmoglein cell adhesion recognition sequence
ENRNTK

SEQ ID NO: 3128 - protein, 7 aa, Artificial Sequence
  Representative cyclic modulating agent based on Desmoglein cell adhesion recognition sequence
ENRNTGK

SEQ ID NO: 3129 - protein, 6 aa, Artificial Sequence
  Representative cyclic modulating agent based on Desmoglein cell adhesion recognition sequence
EINRNK

SEQ ID NO: 3130 - protein, 7 aa, Artificial Sequence
  Representative cyclic modulating agent based on Desmoglein cell adhesion recognition sequence
EINRNTK

SEQ ID NO: 3131 - protein, 8 aa, Artificial Sequence
  Representative cyclic modulating agent based on Desmoglein cell adhesion recognition sequence
EINRNTGK

SEQ ID NO: 3132 - protein, 7 aa, Artificial Sequence
  Representative cyclic modulating agent based on Desmoglein cell adhesion recognition sequence
EIINRNK

SEQ ID NO: 3133 - protein, 8 aa, Artificial Sequence
  Representative cyclic modulating agent based on Desmoglein cell adhesion recognition sequence
EIINRNTK

SEQ ID NO: 3134 - protein, 9 aa, Artificial Sequence
  Representative cyclic modulating agent based on Desmoglein cell adhesion recognition sequence
EIINRNTGK

SEQ ID NO: 3135 - protein, 8 aa, Artificial Sequence
  Representative cyclic modulating agent based on Desmoglein cell adhesion recognition sequence
EFIINRNK

SEQ ID NO: 3136 - protein, 9 aa, Artificial Sequence
  Representative cyclic modulating agent based on Desmoglein cell adhesion recognition sequence
EFIINRNTK

SEQ ID NO: 3137 - protein, 10 aa, Artificial Sequence
  Representative cyclic modulating agent based on Desmoglein cell adhesion recognition sequence
EFIINRNTGK

SEQ ID NO: 3138 - protein, 9 aa, Artificial Sequence
  Representative cyclic modulating agent based on Desmoglein cell adhesion recognition sequence
EMFIINRNK

SEQ ID NO: 3139 - protein, 10 aa, Artificial Sequence
  Representative cyclic modulating agent based on Desmoglein cell adhesion recognition sequence
EMFIINRNTK

SEQ ID NO: 3140 - protein, 11 aa, Artificial Sequence
  Representative cyclic modulating agent based on Desmoglein cell adhesion recognition sequence
EMFIINRNTGK

SEQ ID NO: 3141 - protein, 5 aa, Artificial Sequence
  Representative cyclic modulating agent based on Desmoglein cell adhesion recognition sequence
ENKDK

SEQ ID NO: 3142 - protein, 6 aa, Artificial Sequence
  Representative cyclic modulating agent based on Desmoglein cell adhesion recognition sequence
ENKDTK

SEQ ID NO: 3143 - protein, 7 aa, Artificial Sequence
  Representative cyclic modulating agent based on Desmoglein cell adhesion recognition sequence
ENKDTGK

SEQ ID NO: 3144 - protein, 6 aa, Artificial Sequence
  Representative cyclic modulating agent based on Desmoglein cell adhesion recognition sequence
ELNKDK

SEQ ID NO: 3145 - protein, 7 aa, Artificial Sequence
  Representative cyclic modulating agent based on Desmoglein cell adhesion recognition sequence
ELNKDTK

SEQ ID NO: 3146 - protein, 8 aa, Artificial Sequence
  Representative cyclic modulating agent based on Desmoglein cell adhesion recognition sequence
ELNKDTGK

SEQ ID NO: 3147 - protein, 7 aa, Artificial Sequence
  Representative cyclic modulating agent based on Desmoglein cell adhesion recognition sequence
EYLNKDK

SEQ ID NO: 3148 - protein, 8 aa, Artificial Sequence
  Representative cyclic modulating agent based on Desmoglein cell adhesion recognition sequence
EYLNKDTK

SEQ ID NO: 3149 - protein, 9 aa, Artificial Sequence
  Representative cyclic modulating agent based on Desmoglein cell adhesion recognition sequence
EYLNKDTGK

SEQ ID NO: 3150 - protein, 8 aa, Artificial Sequence
  Representative cyclic modulating agent based on Desmoglein cell adhesion recognition sequence
EFYLNKDK

SEQ ID NO: 3151 - protein, 9 aa, Artificial Sequence
  Representative cyclic modulating agent based on Desmoglein cell adhesion recognition sequence
EFYLNKDTK

SEQ ID NO: 3152 - protein, 10 aa, Artificial Sequence
  Representative cyclic modulating agent based on Desmoglein cell adhesion recognition sequence
EFYLNKDTGK

SEQ ID NO: 3153 - protein, 9 aa, Artificial Sequence
  Representative cyclic modulating agent based on Desmoglein cell adhesion recognition sequence
EVFYLNKDK

SEQ ID NO: 3154 - protein, 10 aa, Artificial Sequence
  Representative cyclic modulating agent based on Desmoglein cell adhesion recognition sequence
EVFYLNKDTK

SEQ ID NO: 3155 - protein, 11 aa, Artificial Sequence
  Representative cyclic modulating agent based on Desmoglein cell adhesion recognition sequence
EVFYLNKDTGK

SEQ ID NO: 3156 - protein, 5 aa, Artificial Sequence
  Representative cyclic modulating agent based on Desmoglein cell adhesion recognition sequence
KNQKD

SEQ ID NO: 3157 - protein, 6 aa, Artificial Sequence
  Representative cyclic modulating agent based on Desmoglein cell adhesion recognition sequence
KNQKTD

SEQ ID NO: 3158 - protein, 7 aa, Artificial Sequence
  Representative cyclic modulating agent based on Desmoglein cell adhesion recognition sequence
KNQKTGD

SEQ ID NO: 3159 - protein, 6 aa, Artificial Sequence
  Representative cyclic modulating agent based on Desmoglein cell adhesion recognition sequence
KINQKD

SEQ ID NO: 3160 - protein, 7 aa, Artificial Sequence
  Representative cyclic modulating agent based on Desmoglein cell adhesion recognition sequence
KINQKTD

SEQ ID NO: 3161 - protein, 8 aa, Artificial Sequence
  Representative cyclic modulating agent based on Desmoglein cell adhesion recognition sequence
KINQKTGD

SEQ ID NO: 3162 - protein, 7 aa, Artificial Sequence
  Representative cyclic modulating agent based on Desmoglein cell adhesion recognition sequence
KVINQKD

SEQ ID NO: 3163 - protein, 8 aa, Artificial Sequence
  Representative cyclic modulating agent based on Desmoglein cell adhesion recognition sequence
KVINQKTD

SEQ ID NO: 3164 - protein, 9 aa, Artificial Sequence
  Representative cyclic modulating agent based on Desmoglein cell adhesion recognition sequence
KVINQKTGD

SEQ ID NO: 3165 - protein, 8 aa, Artificial Sequence
  Representative cyclic modulating agent based on Desmoglein cell adhesion recognition sequence
KFVINQKD

SEQ ID NO: 3166 - protein, 9 aa, Artificial Sequence
  Representative cyclic modulating agent based on Desmoglein cell adhesion recognition sequence
KFVINQKTD

SEQ ID NO: 3167 - protein, 10 aa, Artificial Sequence
  Representative cyclic modulating agent based on Desmoglein cell adhesion recognition sequence
KFVINQKTGD

SEQ ID NO: 3168 - protein, 9 aa, Artificial Sequence
  Representative cyclic modulating agent based on Desmoglein cell adhesion recognition sequence
KIFVINQKD

SEQ ID NO: 3169 - protein, 10 aa, Artificial Sequence
  Representative cyclic modulating agent based on Desmoglein cell adhesion recognition sequence
KIFVINQKTD

SEQ ID NO: 3170 - protein, 11 aa, Artificial Sequence
  Representative cyclic modulating agent based on Desmoglein cell adhesion recognition sequence
KIFVINQKTGD

SEQ ID NO: 3171 - protein, 5 aa, Artificial Sequence
  Representative cyclic modulating agent based on Desmoglein cell adhesion recognition sequence
KNRND

SEQ ID NO: 3172 - protein, 6 aa, Artificial Sequence
  Representative cyclic modulating agent based on Desmoglein cell adhesion recognition sequence
KNRNTD

SEQ ID NO: 3173 - protein, 7 aa, Artificial Sequence
  Representative cyclic modulating agent based on Desmoglein cell adhesion recognition sequence
KNRNTGD

SEQ ID NO: 3174 - protein, 6 aa, Artificial Sequence
  Representative cyclic modulating agent based on Desmoglein cell adhesion recognition sequence
KINRND

SEQ ID NO: 3175 - protein, 7 aa, Artificial Sequence
  Representative cyclic modulating agent based on Desmoglein cell adhesion recognition sequence
KINRNTD

SEQ ID NO: 3176 - protein, 8 aa, Artificial Sequence
  Representative cyclic modulating agent based on Desmoglein cell adhesion recognition sequence
KINRNTGD

SEQ ID NO: 3177 - protein, 7 aa, Artificial Sequence
  Representative cyclic modulating agent based on Desmoglein cell adhesion recognition sequence
KIINRND

SEQ ID NO: 3178 - protein, 8 aa, Artificial Sequence
  Representative cyclic modulating agent based on Desmoglein cell adhesion recognition sequence
KIINRNTD

SEQ ID NO: 3179 - protein, 9 aa, Artificial Sequence
  Representative cyclic modulating agent based on Desmoglein cell adhesion recognition sequence
KIINRNTGD

SEQ ID NO: 3180 - protein, 8 aa, Artificial Sequence
  Representative cyclic modulating agent based on Desmoglein cell adhesion recognition sequence
KFIINRND

SEQ ID NO: 3181 - protein, 9 aa, Artificial Sequence
  Representative cyclic modulating agent based on Desmoglein cell adhesion recognition sequence
KFIINRNTD

SEQ ID NO: 3182 - protein, 10 aa, Artificial Sequence
  Representative cyclic modulating agent based on Desmoglein cell adhesion recognition sequence
KFIINRNTGD

SEQ ID NO: 3183 - protein, 9 aa, Artificial Sequence
  Representative cyclic modulating agent based on Desmoglein cell adhesion recognition sequence
KMFIINRND

SEQ ID NO: 3184 - protein, 10 aa, Artificial Sequence
  Representative cyclic modulating agent based on Desmoglein cell adhesion recognition sequence
KMFIINRNTD

SEQ ID NO: 3185 - protein, 11 aa, Artificial Sequence
  Representative cyclic modulating agent based on Desmoglein cell adhesion recognition sequence
KMFIINRNTGD

SEQ ID NO: 3186 - protein, 5 aa, Artificial Sequence
  Representative cyclic modulating agent based on Desmoglein cell adhesion recognition sequence
KNKDD

SEQ ID NO: 3187 - protein, 6 aa, Artificial Sequence
  Representative cyclic modulating agent based on Desmoglein cell adhesion recognition sequence
KNKDTD

SEQ ID NO: 3188 - protein, 7 aa, Artificial Sequence
  Representative cyclic modulating agent based on Desmoglein cell adhesion recognition sequence
KNKDTGD

SEQ ID NO: 3189 - protein, 6 aa, Artificial Sequence
  Representative cyclic modulating agent based on Desmoglein cell adhesion recognition sequence
KLNKDD

SEQ ID NO: 3190 - protein, 7 aa, Artificial Sequence
  Representative cyclic modulating agent based on Desmoglein cell adhesion recognition sequence
KLNKDTD

SEQ ID NO: 3191 - protein, 8 aa, Artificial Sequence
  Representative cyclic modulating agent based on Desmoglein cell adhesion recognition sequence
KLNKDTGD

SEQ ID NO: 3192 - protein, 7 aa, Artificial Sequence
  Representative cyclic modulating agent based on Desmoglein cell adhesion recognition sequence
KYLNKDD

SEQ ID NO: 3193 - protein, 8 aa, Artificial Sequence
  Representative cyclic modulating agent based on Desmoglein cell adhesion recognition sequence
KYLNKDTD

SEQ ID NO: 3194 - protein, 9 aa, Artificial Sequence
  Representative cyclic modulating agent based on Desmoglein cell adhesion recognition sequence
KYLNKDTGD

SEQ ID NO: 3195 - protein, 8 aa, Artificial Sequence
  Representative cyclic modulating agent based on Desmoglein cell adhesion recognition sequence
KFYLNKDD

SEQ ID NO: 3196 - protein, 9 aa, Artificial Sequence
  Representative cyclic modulating agent based on Desmoglein cell adhesion recognition sequence
KFYLNKDTD

SEQ ID NO: 3197 - protein, 10 aa, Artificial Sequence
  Representative cyclic modulating agent based on Desmoglein cell adhesion recognition sequence
KFYLNKDTGD

SEQ ID NO: 3198 - protein, 9 aa, Artificial Sequence
  Representative cyclic modulating agent based on Desmoglein cell adhesion recognition sequence
KVFYLNKDD

SEQ ID NO: 3199 - protein, 10 aa, Artificial Sequence
  Representative cyclic modulating agent based on Desmoglein cell adhesion recognition sequence
KVFYLNKDTD

SEQ ID NO: 3200 - protein, 11 aa, Artificial Sequence
  Representative cyclic modulating agent based on Desmoglein cell adhesion recognition sequence
KVFYLNKDTGD

SEQ ID NO: 3201 - protein, 5 aa, Artificial Sequence
  Representative cyclic modulating agent based on Desmoglein cell adhesion recognition sequence
DNQKK

SEQ ID NO: 3202 - protein, 6 aa, Artificial Sequence
  Representative cyclic modulating agent based on Desmoglein cell adhesion recognition sequence
DNQKTK

SEQ ID NO: 3203 - protein, 7 aa, Artificial Sequence
  Representative cyclic modulating agent based on Desmoglein cell adhesion recognition sequence
DNQKTGK

SEQ ID NO: 3204 - protein, 6 aa, Artificial Sequence
  Representative cyclic modulating agent based on Desmoglein cell adhesion recognition sequence
DINQKK

SEQ ID NO: 3205 - protein, 7 aa, Artificial Sequence
  Representative cyclic modulating agent based on Desmoglein cell adhesion recognition sequence
DINQKTK

SEQ ID NO: 3206 - protein, 8 aa, Artificial Sequence
  Representative cyclic modulating agent based on Desmoglein cell adhesion recognition sequence
DINQKTGK

SEQ ID NO: 3207 - protein, 7 aa, Artificial Sequence
  Representative cyclic modulating agent based on Desmoglein cell adhesion recognition sequence
DVINQKK

SEQ ID NO: 3208 - protein, 8 aa, Artificial Sequence
  Representative cyclic modulating agent based on Desmoglein cell adhesion recognition sequence
DVINQKTK

SEQ ID NO: 3209 - protein, 9 aa, Artificial Sequence
  Representative cyclic modulating agent based on Desmoglein cell adhesion recognition sequence
DVINQKTGK

SEQ ID NO: 3210 - protein, 8 aa, Artificial Sequence
  Representative cyclic modulating agent based on Desmoglein cell adhesion recognition sequence
DFVINQKK

SEQ ID NO: 3211 - protein, 9 aa, Artificial Sequence
  Representative cyclic modulating agent based on Desmoglein cell adhesion recognition sequence
DFVINQKTK

SEQ ID NO: 3212 - protein, 10 aa, Artificial Sequence
  Representative cyclic modulating agent based on Desmoglein cell adhesion recognition sequence
DFVINQKTGK

SEQ ID NO: 3213 - protein, 9 aa, Artificial Sequence
  Representative cyclic modulating agent based on Desmoglein cell adhesion recognition sequence
DIFVINQKK

SEQ ID NO: 3214 - protein, 10 aa, Artificial Sequence
  Representative cyclic modulating agent based on Desmoglein cell adhesion recognition sequence
DIFVINQKTK

SEQ ID NO: 3215 - protein, 11 aa, Artificial Sequence
  Representative cyclic modulating agent based on Desmoglein cell adhesion recognition sequence
DIFVINQKTGK

SEQ ID NO: 3216 - protein, 5 aa, Artificial Sequence
  Representative cyclic modulating agent based on Desmoglein cell adhesion recognition sequence
DNRNK

SEQ ID NO: 3217 - protein, 6 aa, Artificial Sequence
  Representative cyclic modulating agent based on Desmoglein cell adhesion recognition sequence
DNRNTK

SEQ ID NO: 3218 - protein, 7 aa, Artificial Sequence
  Representative cyclic modulating agent based on Desmoglein cell adhesion recognition sequence
DNRNTGK

SEQ ID NO: 3219 - protein, 6 aa, Artificial Sequence
  Representative cyclic modulating agent based on Desmoglein cell adhesion recognition sequence
DINRNK

SEQ ID NO: 3220 - protein, 7 aa, Artificial Sequence
  Representative cyclic modulating agent based on Desmoglein cell adhesion recognition sequence
DINRNTK

SEQ ID NO: 3221 - protein, 8 aa, Artificial Sequence
  Representative cyclic modulating agent based on Desmoglein cell adhesion recognition sequence
DINRNTGK

SEQ ID NO: 3222 - protein, 7 aa, Artificial Sequence
  Representative cyclic modulating agent based on Desmoglein cell adhesion recognition sequence
DIINRNK

SEQ ID NO: 3223 - protein, 8 aa, Artificial Sequence
  Representative cyclic modulating agent based on Desmoglein cell adhesion recognition sequence
DIINRNTK

SEQ ID NO: 3224 - protein, 9 aa, Artificial Sequence
  Representative cyclic modulating agent based on Desmoglein cell adhesion recognition sequence
DIINRNTGK

SEQ ID NO: 3225 - protein, 8 aa, Artificial Sequence
  Representative cyclic modulating agent based on Desmoglein cell adhesion recognition sequence
DFIINRNK

SEQ ID NO: 3226 - protein, 9 aa, Artificial Sequence
  Representative cyclic modulating agent based on Desmoglein cell adhesion recognition sequence
DFIINRNTK

SEQ ID NO: 3227 - protein, 10 aa, Artificial Sequence
  Representative cyclic modulating agent based on Desmoglein cell adhesion recognition sequence
DFIINRNTGK

SEQ ID NO: 3228 - protein, 9 aa, Artificial Sequence
  Representative cyclic modulating agent based on Desmoglein cell adhesion recognition sequence
DMFIINRNK

SEQ ID NO: 3229 - protein, 10 aa, Artificial Sequence
  Representative cyclic modulating agent based on Desmoglein cell adhesion recognition sequence
DMFIINRNTK

SEQ ID NO: 3230 - protein, 11 aa, Artificial Sequence
  Representative cyclic modulating agent based on Desmoglein cell adhesion recognition sequence
DMFIINRNTGK

SEQ ID NO: 3231 - protein, 5 aa, Artificial Sequence
  Representative cyclic modulating agent based on Desmoglein cell adhesion recognition sequence
DNKDK

SEQ ID NO: 3232 - protein, 6 aa, Artificial Sequence
  Representative cyclic modulating agent based on Desmoglein cell adhesion recognition sequence
DNKDTK

SEQ ID NO: 3233 - protein, 7 aa, Artificial Sequence
  Representative cyclic modulating agent based on Desmoglein cell adhesion recognition sequence
DNKDTGK

SEQ ID NO: 3234 - protein, 6 aa, Artificial Sequence
  Representative cyclic modulating agent based on Desmoglein cell adhesion recognition sequence
DLNKDK

SEQ ID NO: 3235 - protein, 7 aa, Artificial Sequence
  Representative cyclic modulating agent based on Desmoglein cell adhesion recognition sequence
DLNKDTK

SEQ ID NO: 3236 - protein, 8 aa, Artificial Sequence
  Representative cyclic modulating agent based on Desmoglein cell adhesion recognition sequence
DLNKDTGK

SEQ ID NO: 3237 - protein, 7 aa, Artificial Sequence
  Representative cyclic modulating agent based on Desmoglein cell adhesion recognition sequence
DYLNKDK

SEQ ID NO: 3238 - protein, 8 aa, Artificial Sequence
  Representative cyclic modulating agent based on Desmoglein cell adhesion recognition sequence
DYLNKDTK

SEQ ID NO: 3239 - protein, 9 aa, Artificial Sequence
  Representative cyclic modulating agent based on Desmoglein cell adhesion recognition sequence
DYLNKDTGK

SEQ ID NO: 3240 - protein, 8 aa, Artificial Sequence
  Representative cyclic modulating agent based on Desmoglein cell adhesion recognition sequence
DFYLNKDK

SEQ ID NO: 3241 - protein, 9 aa, Artificial Sequence
  Representative cyclic modulating agent based on Desmoglein cell adhesion recognition sequence
DFYLNKDTK

SEQ ID NO: 3242 - protein, 10 aa, Artificial Sequence
  Representative cyclic modulating agent based on Desmoglein cell adhesion recognition sequence
DFYLNKDTGK

SEQ ID NO: 3243 - protein, 9 aa, Artificial Sequence
  Representative cyclic modulating agent based on Desmoglein cell adhesion recognition sequence
DVFYLNKDK

SEQ ID NO: 3244 - protein, 10 aa, Artificial Sequence
  Representative cyclic modulating agent based on Desmoglein cell adhesion recognition sequence
DVFYLNKDTK

SEQ ID NO: 3245 - protein, 11 aa, Artificial Sequence
  Representative cyclic modulating agent based on Desmoglein cell adhesion recognition sequence
DVFYLNKDTGK

SEQ ID NO: 3246 - protein, 6 aa, Artificial Sequence
  Representative cyclic modulating agent based on Desmoglein cell adhesion recognition sequence
KKNQKE

SEQ ID NO: 3247 - protein, 6 aa, Artificial Sequence
  Representative cyclic modulating agent based on Desmoglein cell adhesion recognition sequence
KNQKTE

SEQ ID NO: 3248 - protein, 7 aa, Artificial Sequence
  Representative cyclic modulating agent based on Desmoglein cell adhesion recognition sequence
KNQKTGE

SEQ ID NO: 3249 - protein, 6 aa, Artificial Sequence
  Representative cyclic modulating agent based on Desmoglein cell adhesion recognition sequence
KINQKE

SEQ ID NO: 3250 - protein, 7 aa, Artificial Sequence
  Representative cyclic modulating agent based on Desmoglein cell adhesion recognition sequence
KINQKTE

SEQ ID NO: 3251 - protein, 8 aa, Artificial Sequence
  Representative cyclic modulating agent based on Desmoglein cell adhesion recognition sequence
KINQKTGE

SEQ ID NO: 3252 - protein, 7 aa, Artificial Sequence
  Representative cyclic modulating agent based on Desmoglein cell adhesion recognition sequence
KVINQKE

SEQ ID NO: 3253 - protein, 8 aa, Artificial Sequence
  Representative cyclic modulating agent based on Desmoglein cell adhesion recognition sequence
KVINQKTE

SEQ ID NO: 3254 - protein, 9 aa, Artificial Sequence
  Representative cyclic modulating agent based on Desmoglein cell adhesion recognition sequence
KVINQKTGE

SEQ ID NO: 3255 - protein, 8 aa, Artificial Sequence
  Representative cyclic modulating agent based on Desmoglein cell adhesion recognition sequence
KFVINQKE

SEQ ID NO: 3256 - protein, 9 aa, Artificial Sequence
  Representative cyclic modulating agent based on Desmoglein cell adhesion recognition sequence
KFVINQKTE

SEQ ID NO: 3257 - protein, 10 aa, Artificial Sequence
  Representative cyclic modulating agent based on Desmoglein cell adhesion recognition sequence
KFVINQKTGE

SEQ ID NO: 3258 - protein, 9 aa, Artificial Sequence
  Representative cyclic modulating agent based on Desmoglein cell adhesion recognition sequence
KIFVINQKE

SEQ ID NO: 3259 - protein, 10 aa, Artificial Sequence
  Representative cyclic modulating agent based on Desmoglein cell adhesion recognition sequence
KIFVINQKTE

SEQ ID NO: 3260 - protein, 11 aa, Artificial Sequence
  Representative cyclic modulating agent based on Desmoglein cell adhesion recognition sequence
KIFVINQKTGE

SEQ ID NO: 3261 - protein, 5 aa, Artificial Sequence
  Representative cyclic modulating agent based on Desmoglein cell adhesion recognition sequence
KNRNE

SEQ ID NO: 3262 - protein, 6 aa, Artificial Sequence
  Representative cyclic modulating agent based on Desmoglein cell adhesion recognition sequence
KNRNTE

SEQ ID NO: 3263 - protein, 7 aa, Artificial Sequence
  Representative cyclic modulating agent based on Desmoglein cell adhesion recognition sequence
KNRNTGE

SEQ ID NO: 3264 - protein, 6 aa, Artificial Sequence
  Representative cyclic modulating agent based on Desmoglein cell adhesion recognition sequence
KINRNE

SEQ ID NO: 3265 - protein, 7 aa, Artificial Sequence
  Representative cyclic modulating agent based on Desmoglein cell adhesion recognition sequence
KINRNTE

SEQ ID NO: 3266 - protein, 8 aa, Artificial Sequence
  Representative cyclic modulating agent based on Desmoglein cell adhesion recognition sequence
KINRNTGE

SEQ ID NO: 3267 - protein, 7 aa, Artificial Sequence
  Representative cyclic modulating agent based on Desmoglein cell adhesion recognition sequence
KIINRNE

SEQ ID NO: 3268 - protein, 8 aa, Artificial Sequence
  Representative cyclic modulating agent based on Desmoglein cell adhesion recognition sequence
KIINRNTE

SEQ ID NO: 3269 - protein, 9 aa, Artificial Sequence
  Representative cyclic modulating agent based on Desmoglein cell adhesion recognition sequence
KIINRNTGE

SEQ ID NO: 3270 - protein, 8 aa, Artificial Sequence
  Representative cyclic modulating agent based on Desmoglein cell adhesion recognition sequence
KFIINRNE

SEQ ID NO: 3271 - protein, 9 aa, Artificial Sequence
  Representative cyclic modulating agent based on Desmoglein cell adhesion recognition sequence
KFIINRNTE

SEQ ID NO: 3272 - protein, 10 aa, Artificial Sequence
  Representative cyclic modulating agent based on Desmoglein cell adhesion recognition sequence
KFIINRNTGE

SEQ ID NO: 3273 - protein, 9 aa, Artificial Sequence
  Representative cyclic modulating agent based on Desmoglein cell adhesion recognition sequence
KMFIINRNE

SEQ ID NO: 3274 - protein, 10 aa, Artificial Sequence
  Representative cyclic modulating agent based on Desmoglein cell adhesion recognition sequence
KMFIINRNTE

SEQ ID NO: 3275 - protein, 11 aa, Artificial Sequence
  Representative cyclic modulating agent based on Desmoglein cell adhesion recognition sequence
KMFIINRNTGE

SEQ ID NO: 3276 - protein, 5 aa, Artificial Sequence
  Representative cyclic modulating agent based on Desmoglein cell adhesion recognition sequence
KNKDE

SEQ ID NO: 3277 - protein, 6 aa, Artificial Sequence
  Representative cyclic modulating agent based on Desmoglein cell adhesion recognition sequence
KNKDTE

SEQ ID NO: 3278 - protein, 7 aa, Artificial Sequence
  Representative cyclic modulating agent based on Desmoglein cell adhesion recognition sequence
KNKDTGE

SEQ ID NO: 3279 - protein, 6 aa, Artificial Sequence
  Representative cyclic modulating agent based on Desmoglein cell adhesion recognition sequence
KLNKDE

SEQ ID NO: 3280 - protein, 7 aa, Artificial Sequence
  Representative cyclic modulating agent based on Desmoglein cell adhesion recognition sequence
KLNKDTE

SEQ ID NO: 3281 - protein, 8 aa, Artificial Sequence
  Representative cyclic modulating agent based on Desmoglein cell adhesion recognition sequence
KLNKDTGE

SEQ ID NO: 3282 - protein, 7 aa, Artificial Sequence
  Representative cyclic modulating agent based on Desmoglein cell adhesion recognition sequence
KYLNKDE

SEQ ID NO: 3283 - protein, 8 aa, Artificial Sequence
  Representative cyclic modulating agent based on Desmoglein cell adhesion recognition sequence
KYLNKDTE

SEQ ID NO: 3284 - protein, 9 aa, Artificial Sequence
  Representative cyclic modulating agent based on Desmoglein cell adhesion recognition sequence
KYLNKDTGE

SEQ ID NO: 3285 - protein, 8 aa, Artificial Sequence
  Representative cyclic modulating agent based on Desmoglein cell adhesion recognition sequence
KFYLNKDE

SEQ ID NO: 3286 - protein, 9 aa, Artificial Sequence
  Representative cyclic modulating agent based on Desmoglein cell adhesion recognition sequence
KFYLNKDTE

SEQ ID NO: 3287 - protein, 10 aa, Artificial Sequence
  Representative cyclic modulating agent based on Desmoglein cell adhesion recognition sequence
KFYLNKDTGE

SEQ ID NO: 3288 - protein, 9 aa, Artificial Sequence
  Representative cyclic modulating agent based on Desmoglein cell adhesion recognition sequence
KVFYLNKDE

SEQ ID NO: 3289 - protein, 10 aa, Artificial Sequence
  Representative cyclic modulating agent based on Desmoglein cell adhesion recognition sequence
KVFYLNKDTE

SEQ ID NO: 3290 - protein, 11 aa, Artificial Sequence
  Representative cyclic modulating agent based on Desmoglein cell adhesion recognition sequence
KVFYLNKDTGE

SEQ ID NO: 3291 - protein, 5 aa, Artificial Sequence
  Representative cyclic modulating agent based on Desmoglein cell adhesion recognition sequence
NQKTG

SEQ ID NO: 3292 - protein, 5 aa, Artificial Sequence
  Representative cyclic modulating agent based on Desmoglein cell adhesion recognition sequence
INQKT

SEQ ID NO: 3293 - protein, 6 aa, Artificial Sequence
  Representative cyclic modulating agent based on Desmoglein cell adhesion recognition sequence
INQKTG

SEQ ID NO: 3294 - protein, 5 aa, Artificial Sequence
  Representative cyclic modulating agent based on Desmoglein cell adhesion recognition sequence
VINQK

SEQ ID NO: 3295 - protein, 6 aa, Artificial Sequence
  Representative cyclic modulating agent based on Desmoglein cell adhesion recognition sequence
VINQKT

SEQ ID NO: 3296 - protein, 7 aa, Artificial Sequence
  Representative cyclic modulating agent based on Desmoglein cell adhesion recognition sequence
VINQKTG

SEQ ID NO: 3297 - protein, 6 aa, Artificial Sequence
  Representative cyclic modulating agent based on Desmoglein cell adhesion recognition sequence
FVINQK

SEQ ID NO: 3298 - protein, 7 aa, Artificial Sequence
  Representative cyclic modulating agent based on Desmoglein cell adhesion recognition sequence
FVINQKT

SEQ ID NO: 3299 - protein, 8 aa, Artificial Sequence
  Representative cyclic modulating agent based on Desmoglein cell adhesion recognition sequence
FVINQKTG

SEQ ID NO: 3300 - protein, 7 aa, Artificial Sequence
  Representative cyclic modulating agent based on Desmoglein cell adhesion recognition sequence
IFVINQK

SEQ ID NO: 3301 - protein, 8 aa, Artificial Sequence
  Representative cyclic modulating agent based on Desmoglein cell adhesion recognition sequence
IFVINQKT

SEQ ID NO: 3302 - protein, 9 aa, Artificial Sequence
  Representative cyclic modulating agent based on Desmoglein cell adhesion recognition sequence
IFVINQKTG

SEQ ID NO: 3303 - protein, 5 aa, Artificial Sequence
  Representative cyclic modulating agent based on Desmoglein cell adhesion recognition sequence
NRNTG

SEQ ID NO: 3304 - protein, 5 aa, Artificial Sequence
  Representative cyclic modulating agent based on Desmoglein cell adhesion recognition sequence
INRNT

SEQ ID NO: 3305 - protein, 6 aa, Artificial Sequence
  Representative cyclic modulating agent based on Desmoglein cell adhesion recognition sequence
INRNTG

SEQ ID NO: 3306 - protein, 5 aa, Artificial Sequence
  Representative cyclic modulating agent based on Desmoglein cell adhesion recognition sequence
IINRN

SEQ ID NO: 3307 - protein, 6 aa, Artificial Sequence
  Representative cyclic modulating agent based on Desmoglein cell adhesion recognition sequence
IINRNT

SEQ ID NO: 3308 - protein, 7 aa, Artificial Sequence
  Representative cyclic modulating agent based on Desmoglein cell adhesion recognition sequence
IINRNTG

SEQ ID NO: 3309 - protein, 6 aa, Artificial Sequence
  Representative cyclic modulating agent based on Desmoglein cell adhesion recognition sequence
FIINRN

SEQ ID NO: 3310 - protein, 7 aa, Artificial Sequence
  Representative cyclic modulating agent based on Desmoglein cell adhesion recognition sequence
FIINRNT

SEQ ID NO: 3311 - protein, 8 aa, Artificial Sequence
  Representative cyclic modulating agent based on Desmoglein cell adhesion recognition sequence
FIINRNTG

SEQ ID NO: 3312 - protein, 7 aa, Artificial Sequence
  Representative cyclic modulating agent based on Desmoglein cell adhesion recognition sequence
MFIINRN

SEQ ID NO: 3313 - protein, 8 aa, Artificial Sequence
  Representative cyclic modulating agent based on Desmoglein cell adhesion recognition sequence
MFIINRNT

SEQ ID NO: 3314 - protein, 9 aa, Artificial Sequence
  Representative cyclic modulating agent based on Desmoglein cell adhesion recognition sequence
MFIINRNTG

SEQ ID NO: 3315 - protein, 5 aa, Artificial Sequence
  Representative cyclic modulating agent based on Desmoglein cell adhesion recognition sequence
NKDTG

SEQ ID NO: 3316 - protein, 5 aa, Artificial Sequence
  Representative cyclic modulating agent based on Desmoglein cell adhesion recognition sequence
LNKDT

SEQ ID NO: 3317 - protein, 6 aa, Artificial Sequence
  Representative cyclic modulating agent based on Desmoglein cell adhesion recognition sequence
LNKDTG

SEQ ID NO: 3318 - protein, 5 aa, Artificial Sequence
  Representative cyclic modulating agent based on Desmoglein cell adhesion recognition sequence
YLNKD

SEQ ID NO: 3319 - protein, 6 aa, Artificial Sequence
  Representative cyclic modulating agent based on Desmoglein cell adhesion recognition sequence
YLNKDT

SEQ ID NO: 3320 - protein, 7 aa, Artificial Sequence
  Representative cyclic modulating agent based on Desmoglein cell adhesion recognition sequence
YLNKDTG

SEQ ID NO: 3321 - protein, 6 aa, Artificial Sequence
  Representative cyclic modulating agent based on Desmoglein cell adhesion recognition sequence
FYLNKD

SEQ ID NO: 3322 - protein, 7 aa, Artificial Sequence
  Representative cyclic modulating agent based on Desmoglein cell adhesion recognition sequence
FYLNKDT

SEQ ID NO: 3323 - protein, 8 aa, Artificial Sequence
  Representative cyclic modulating agent based on Desmoglein cell adhesion recognition sequence
FYLNKDTG

SEQ ID NO: 3324 - protein, 7 aa, Artificial Sequence
  Representative cyclic modulating agent based on Desmoglein cell adhesion recognition sequence
VFYLNKD

SEQ ID NO: 3325 - protein, 8 aa, Artificial Sequence
  Representative cyclic modulating agent based on Desmoglein cell adhesion recognition sequence
VFYLNKDT

SEQ ID NO: 3326 - protein, 9 aa, Artificial Sequence
  Representative cyclic modulating agent based on Desmoglein cell adhesion recognition sequence
VFYLNKDTG

SEQ ID NO: 3327 - protein, 5 aa, Artificial Sequence
  Representative cyclic modulating agent based on Desmocollin cell adhesion recognition sequence
CEKDC

SEQ ID NO: 3328 - protein, 6 aa, Artificial Sequence
  Representative cyclic modulating agent based on Desmocollin cell adhesion recognition sequence
CEKDTC

SEQ ID NO: 3329 - protein, 7 aa, Artificial Sequence
  Representative cyclic modulating agent based on Desmocollin cell adhesion recognition sequence
CEKDTGC

SEQ ID NO: 3330 - protein, 6 aa, Artificial Sequence
  Representative cyclic modulating agent based on Desmocollin cell adhesion recognition sequence
CIEKDC

SEQ ID NO: 3331 - protein, 7 aa, Artificial Sequence
  Representative cyclic modulating agent based on Desmocollin cell adhesion recognition sequence
CIEKDTC

SEQ ID NO: 3332 - protein, 8 aa, Artificial Sequence
  Representative cyclic modulating agent based on Desmocollin cell adhesion recognition sequence
CIEKDTGC

SEQ ID NO: 3333 - protein, 7 aa, Artificial Sequence
  Representative cyclic modulating agent based on Desmocollin cell adhesion recognition sequence
CYIEKDC

SEQ ID NO: 3334 - protein, 8 aa, Artificial Sequence
  Representative cyclic modulating agent based on Desmocollin cell adhesion recognition sequence
CYIEKDTC

SEQ ID NO: 3335 - protein, 9 aa, Artificial Sequence
  Representative cyclic modulating agent based on Desmocollin cell adhesion recognition sequence
CYIEKDTGC

SEQ ID NO: 3336 - protein, 8 aa, Artificial Sequence
  Representative cyclic modulating agent based on Desmocollin cell adhesion recognition sequence
CFYIEKDC

SEQ ID NO: 3337 - protein, 9 aa, Artificial Sequence
  Representative cyclic modulating agent based on Desmocollin cell adhesion recognition sequence
CFYIEKDTC

SEQ ID NO: 3338 - protein, 10 aa, Artificial Sequence
  Representative cyclic modulating agent based on Desmocollin cell adhesion recognition sequence
CFYIEKDTGC

SEQ ID NO: 3339 - protein, 9 aa, Artificial Sequence
  Representative cyclic modulating agent based on Desmocollin cell adhesion recognition sequence
CLFYIEKDC

SEQ ID NO: 3340 - protein, 10 aa, Artificial Sequence
  Representative cyclic modulating agent based on Desmocollin cell adhesion recognition sequence
CLFYIEKDTC

SEQ ID NO: 3341 - protein, 11 aa, Artificial Sequence
  Representative cyclic modulating agent based on Desmocollin cell adhesion recognition sequence
CLFYIEKDTGC

SEQ ID NO: 3342 - protein, 5 aa, Artificial Sequence
  Representative cyclic modulating agent based on Desmocollin cell adhesion recognition sequence
CERDC

SEQ ID NO: 3343 - protein, 6 aa, Artificial Sequence
  Representative cyclic modulating agent based on Desmocollin cell adhesion recognition sequence
CERDTC

SEQ ID NO: 3344 - protein, 7 aa, Artificial Sequence
  Representative cyclic modulating agent based on Desmocollin cell adhesion recognition sequence
CERDTGC

SEQ ID NO: 3345 - protein, 6 aa, Artificial Sequence
  Representative cyclic modulating agent based on Desmocollin cell adhesion recognition sequence
CVERDC

SEQ ID NO: 3346 - protein, 7 aa, Artificial Sequence
  Representative cyclic modulating agent based on Desmocollin cell adhesion recognition sequence
CVERDTC

SEQ ID NO: 3347 - protein, 8 aa, Artificial Sequence
  Representative cyclic modulating agent based on Desmocollin cell adhesion recognition sequence
CVERDTGC

SEQ ID NO: 3348 - protein, 7 aa, Artificial Sequence
  Representative cyclic modulating agent based on Desmocollin cell adhesion recognition sequence
CYVERDC

SEQ ID NO: 3349 - protein, 8 aa, Artificial Sequence
  Representative cyclic modulating agent based on Desmocollin cell adhesion recognition sequence
CYVERDTC

SEQ ID NO: 3350 - protein, 9 aa, Artificial Sequence
  Representative cyclic modulating agent based on Desmocollin cell adhesion recognition sequence
CYVERDTGC

SEQ ID NO: 3351 - protein, 8 aa, Artificial Sequence
  Representative cyclic modulating agent based on Desmocollin cell adhesion recognition sequence
CFYVERDC

SEQ ID NO: 3352 - protein, 9 aa, Artificial Sequence
  Representative cyclic modulating agent based on Desmocollin cell adhesion recognition sequence
CFYVERDTC

SEQ ID NO: 3353 - protein, 10 aa, Artificial Sequence
  Representative cyclic modulating agent based on Desmocollin cell adhesion recognition sequence
CFYVERDTGC

SEQ ID NO: 3354 - protein, 9 aa, Artificial Sequence
  Representative cyclic modulating agent based on Desmocollin cell adhesion recognition sequence
CLFYVERDC

SEQ ID NO: 3355 - protein, 10 aa, Artificial Sequence
  Representative cyclic modulating agent based on Desmocollin cell adhesion recognition sequence
CLFYVERDTC

SEQ ID NO: 3356 - protein, 11 aa, Artificial Sequence
  Representative cyclic modulating agent based on Desmocollin cell adhesion recognition sequence
CLFYVERDTGC

SEQ ID NO: 3357 - protein, 6 aa, Artificial Sequence
  Representative cyclic modulating agent based on Desmocollin cell adhesion recognition sequence
CIERDC

SEQ ID NO: 3358 - protein, 7 aa, Artificial Sequence
  Representative cyclic modulating agent based on Desmocollin cell adhesion recognition sequence
CIERDTC

SEQ ID NO: 3359 - protein, 8 aa, Artificial Sequence
  Representative cyclic modulating agent based on Desmocollin cell adhesion recognition sequence
CIERDTGC

SEQ ID NO: 3360 - protein, 7 aa, Artificial Sequence
  Representative cyclic modulating agent based on Desmocollin cell adhesion recognition sequence
CYIERDC

SEQ ID NO: 3361 - protein, 8 aa, Artificial Sequence
  Representative cyclic modulating agent based on Desmocollin cell adhesion recognition sequence
CYIERDTC

SEQ ID NO: 3362 - protein, 9 aa, Artificial Sequence
  Representative cyclic modulating agent based on Desmocollin cell adhesion recognition sequence
CYIERDTGC

SEQ ID NO: 3363 - protein, 8 aa, Artificial Sequence
  Representative cyclic modulating agent based on Desmocollin cell adhesion recognition sequence
CFYIERDC

SEQ ID NO: 3364 - protein, 9 aa, Artificial Sequence
  Representative cyclic modulating agent based on Desmocollin cell adhesion recognition sequence
CFYIERDTC

SEQ ID NO: 3365 - protein, 10 aa, Artificial Sequence
  Representative cyclic modulating agent based on Desmocollin cell adhesion recognition sequence
CFYIERDTGC

SEQ ID NO: 3366 - protein, 9 aa, Artificial Sequence
  Representative cyclic modulating agent based on Desmocollin cell adhesion recognition sequence
CLFYIERDC

SEQ ID NO: 3367 - protein, 10 aa, Artificial Sequence
  Representative cyclic modulating agent based on Desmocollin cell adhesion recognition sequence
CLFYIERDTC

SEQ ID NO: 3368 - protein, 11 aa, Artificial Sequence
  Representative cyclic modulating agent based on Desmocollin cell adhesion recognition sequence
CLFYIERDTGC

SEQ ID NO: 3369 - protein, 5 aa, Artificial Sequence
  Representative cyclic modulating agent based on Desmocollin cell adhesion recognition sequence
EEKDK

SEQ ID NO: 3370 - protein, 6 aa, Artificial Sequence
  Representative cyclic modulating agent based on Desmocollin cell adhesion recognition sequence
EEKDTK

SEQ ID NO: 3371 - protein, 7 aa, Artificial Sequence
  Representative cyclic modulating agent based on Desmocollin cell adhesion recognition sequence
EEKDTGK

SEQ ID NO: 3372 - protein, 6 aa, Artificial Sequence
  Representative cyclic modulating agent based on Desmocollin cell adhesion recognition sequence
EIEKDK

SEQ ID NO: 3373 - protein, 7 aa, Artificial Sequence
  Representative cyclic modulating agent based on Desmocollin cell adhesion recognition sequence
EIEKDTK

SEQ ID NO: 3374 - protein, 8 aa, Artificial Sequence
  Representative cyclic modulating agent based on Desmocollin cell adhesion recognition sequence
EIEKDTGK

SEQ ID NO: 3375 - protein, 7 aa, Artificial Sequence
  Representative cyclic modulating agent based on Desmocollin cell adhesion recognition sequence
EYIEKDK

SEQ ID NO: 3376 - protein, 8 aa, Artificial Sequence
  Representative cyclic modulating agent based on Desmocollin cell adhesion recognition sequence
EYIEKDTK

SEQ ID NO: 3377 - protein, 9 aa, Artificial Sequence
  Representative cyclic modulating agent based on Desmocollin cell adhesion recognition sequence
EYIEKDTGK

SEQ ID NO: 3378 - protein, 8 aa, Artificial Sequence
  Representative cyclic modulating agent based on Desmocollin cell adhesion recognition sequence
EFYIEKDK

SEQ ID NO: 3379 - protein, 9 aa, Artificial Sequence
  Representative cyclic modulating agent based on Desmocollin cell adhesion recognition sequence
EFYIEKDTK

SEQ ID NO: 3380 - protein, 10 aa, Artificial Sequence
  Representative cyclic modulating agent based on Desmocollin cell adhesion recognition sequence
EFYIEKDTGK

SEQ ID NO: 3381 - protein, 9 aa, Artificial Sequence
  Representative cyclic modulating agent based on Desmocollin cell adhesion recognition sequence
ELFYIEKDK

SEQ ID NO: 3382 - protein, 10 aa, Artificial Sequence
  Representative cyclic modulating agent based on Desmocollin cell adhesion recognition sequence
ELFYIEKDTK

SEQ ID NO: 3383 - protein, 11 aa, Artificial Sequence
  Representative cyclic modulating agent based on Desmocollin cell adhesion recognition sequence
ELFYIEKDTGK

SEQ ID NO: 3384 - protein, 5 aa, Artificial Sequence
  Representative cyclic modulating agent based on Desmocollin cell adhesion recognition sequence
EERDK

SEQ ID NO: 3385 - protein, 6 aa, Artificial Sequence
  Representative cyclic modulating agent based on Desmocollin cell adhesion recognition sequence
EERDTK

SEQ ID NO: 3386 - protein, 7 aa, Artificial Sequence
  Representative cyclic modulating agent based on Desmocollin cell adhesion recognition sequence
EERDTGK

SEQ ID NO: 3387 - protein, 6 aa, Artificial Sequence
  Representative cyclic modulating agent based on Desmocollin cell adhesion recognition sequence
EVERDK

SEQ ID NO: 3388 - protein, 7 aa, Artificial Sequence
  Representative cyclic modulating agent based on Desmocollin cell adhesion recognition sequence
EVERDTK

SEQ ID NO: 3389 - protein, 8 aa, Artificial Sequence
  Representative cyclic modulating agent based on Desmocollin cell adhesion recognition sequence
EVERDTGK

SEQ ID NO: 3390 - protein, 7 aa, Artificial Sequence
  Representative cyclic modulating agent based on Desmocollin cell adhesion recognition sequence
EYVERDK

SEQ ID NO: 3391 - protein, 7 aa, Artificial Sequence
  Representative cyclic modulating agent based on Desmocollin cell adhesion recognition sequence
YVERDTK

SEQ ID NO: 3392 - protein, 9 aa, Artificial Sequence
  Representative cyclic modulating agent based on Desmocollin cell adhesion recognition sequence
EYVERDTGK

SEQ ID NO: 3393 - protein, 8 aa, Artificial Sequence
  Representative cyclic modulating agent based on Desmocollin cell adhesion recognition sequence
EFYVERDK

SEQ ID NO: 3394 - protein, 9 aa, Artificial Sequence
  Representative cyclic modulating agent based on Desmocollin cell adhesion recognition sequence
EFYVERDTK

SEQ ID NO: 3395 - protein, 10 aa, Artificial Sequence
  Representative cyclic modulating agent based on Desmocollin cell adhesion recognition sequence
EFYVERDTGK

SEQ ID NO: 3396 - protein, 9 aa, Artificial Sequence
  Representative cyclic modulating agent based on Desmocollin cell adhesion recognition sequence
ELFYVERDK

SEQ ID NO: 3397 - protein, 10 aa, Artificial Sequence
  Representative cyclic modulating agent based on Desmocollin cell adhesion recognition sequence
ELFYVERDTK

SEQ ID NO: 3398 - protein, 11 aa, Artificial Sequence
  Representative cyclic modulating agent based on Desmocollin cell adhesion recognition sequence
ELFYVERDTGK

SEQ ID NO: 3399 - protein, 6 aa, Artificial Sequence
  Representative cyclic modulating agent based on Desmocollin cell adhesion recognition sequence
EIERDK

SEQ ID NO: 3400 - protein, 7 aa, Artificial Sequence
  Representative cyclic modulating agent based on Desmocollin cell adhesion recognition sequence
EIERDTK

SEQ ID NO: 3401 - protein, 8 aa, Artificial Sequence
  Representative cyclic modulating agent based on Desmocollin cell adhesion recognition sequence
EIERDTGK

SEQ ID NO: 3402 - protein, 7 aa, Artificial Sequence
  Representative cyclic modulating agent based on Desmocollin cell adhesion recognition sequence
EYIERDK

SEQ ID NO: 3403 - protein, 8 aa, Artificial Sequence
  Representative cyclic modulating agent based on Desmocollin cell adhesion recognition sequence
EYIERDTK

SEQ ID NO: 3404 - protein, 9 aa, Artificial Sequence
  Representative cyclic modulating agent based on Desmocollin cell adhesion recognition sequence
EYIERDTGK

SEQ ID NO: 3405 - protein, 8 aa, Artificial Sequence
  Representative cyclic modulating agent based on Desmocollin cell adhesion recognition sequence
EFYIERDK

SEQ ID NO: 3406 - protein, 9 aa, Artificial Sequence
  Representative cyclic modulating agent based on Desmocollin cell adhesion recognition sequence
EFYIERDTK

SEQ ID NO: 3407 - protein, 10 aa, Artificial Sequence
  Representative cyclic modulating agent based on Desmocollin cell adhesion recognition sequence
EFYIERDTGK

SEQ ID NO: 3408 - protein, 9 aa, Artificial Sequence
  Representative cyclic modulating agent based on Desmocollin cell adhesion recognition sequence
ELFYIERDK

SEQ ID NO: 3409 - protein, 10 aa, Artificial Sequence
  Representative cyclic modulating agent based on Desmocollin cell adhesion recognition sequence
ELFYIERDTK

SEQ ID NO: 3410 - protein, 11 aa, Artificial Sequence
  Representative cyclic modulating agent based on Desmocollin cell adhesion recognition sequence
ELFYIERDTGK

SEQ ID NO: 3411 - protein, 5 aa, Artificial Sequence
  Representative cyclic modulating agent based on Desmocollin cell adhesion recognition sequence
KEKDD

SEQ ID NO: 3412 - protein, 6 aa, Artificial Sequence
  Representative cyclic modulating agent based on Desmocollin cell adhesion recognition sequence
KEKDTD

SEQ ID NO: 3413 - protein, 7 aa, Artificial Sequence
  Representative cyclic modulating agent based on Desmocollin cell adhesion recognition sequence
KEKDTGD

SEQ ID NO: 3414 - protein, 6 aa, Artificial Sequence
  Representative cyclic modulating agent based on Desmocollin cell adhesion recognition sequence
KIEKDD

SEQ ID NO: 3415 - protein, 7 aa, Artificial Sequence
  Representative cyclic modulating agent based on Desmocollin cell adhesion recognition sequence
KIEKDTD

SEQ ID NO: 3416 - protein, 8 aa, Artificial Sequence
  Representative cyclic modulating agent based on Desmocollin cell adhesion recognition sequence
KIEKDTGD

SEQ ID NO: 3417 - protein, 7 aa, Artificial Sequence
  Representative cyclic modulating agent based on Desmocollin cell adhesion recognition sequence
KYIEKDD

SEQ ID NO: 3418 - protein, 8 aa, Artificial Sequence
  Representative cyclic modulating agent based on Desmocollin cell adhesion recognition sequence
KYIEKDTD

SEQ ID NO: 3419 - protein, 9 aa, Artificial Sequence
  Representative cyclic modulating agent based on Desmocollin cell adhesion recognition sequence
KYIEKDTGD

SEQ ID NO: 3420 - protein, 8 aa, Artificial Sequence
  Representative cyclic modulating agent based on Desmocollin cell adhesion recognition sequence
KFYIEKDD

SEQ ID NO: 3421 - protein, 9 aa, Artificial Sequence
  Representative cyclic modulating agent based on Desmocollin cell adhesion recognition sequence
KFYIEKDTD

SEQ ID NO: 3422 - protein, 10 aa, Artificial Sequence
  Representative cyclic modulating agent based on Desmocollin cell adhesion recognition sequence
KFYIEKDTGD

SEQ ID NO: 3423 - protein, 9 aa, Artificial Sequence
  Representative cyclic modulating agent based on Desmocollin cell adhesion recognition sequence
KLFYIEKDD

SEQ ID NO: 3424 - protein, 10 aa, Artificial Sequence
  Representative cyclic modulating agent based on Desmocollin cell adhesion recognition sequence
KLFYIEKDTD

SEQ ID NO: 3425 - protein, 11 aa, Artificial Sequence
  Representative cyclic modulating agent based on Desmocollin cell adhesion recognition sequence
KLFYIEKDTGD

SEQ ID NO: 3426 - protein, 5 aa, Artificial Sequence
  Representative cyclic modulating agent based on Desmocollin cell adhesion recognition sequence
KERDD

SEQ ID NO: 3427 - protein, 6 aa, Artificial Sequence
  Representative cyclic modulating agent based on Desmocollin cell adhesion recognition sequence
KERDTD

SEQ ID NO: 3428 - protein, 7 aa, Artificial Sequence
  Representative cyclic modulating agent based on Desmocollin cell adhesion recognition sequence
KERDTGD

SEQ ID NO: 3429 - protein, 6 aa, Artificial Sequence
  Representative cyclic modulating agent based on Desmocollin cell adhesion recognition sequence
KVERDD

SEQ ID NO: 3430 - protein, 7 aa, Artificial Sequence
  Representative cyclic modulating agent based on Desmocollin cell adhesion recognition sequence
KVERDTD

SEQ ID NO: 3431 - protein, 8 aa, Artificial Sequence
  Representative cyclic modulating agent based on Desmocollin cell adhesion recognition sequence
KVERDTGD

SEQ ID NO: 3432 - protein, 7 aa, Artificial Sequence
  Representative cyclic modulating agent based on Desmocollin cell adhesion recognition sequence
KYVERDD

SEQ ID NO: 3433 - protein, 8 aa, Artificial Sequence
  Representative cyclic modulating agent based on Desmocollin cell adhesion recognition sequence
KYVERDTD

SEQ ID NO: 3434 - protein, 9 aa, Artificial Sequence
  Representative cyclic modulating agent based on Desmocollin cell adhesion recognition sequence
KYVERDTGD

SEQ ID NO: 3435 - protein, 8 aa, Artificial Sequence
  Representative cyclic modulating agent based on Desmocollin cell adhesion recognition sequence
KFYVERDD

SEQ ID NO: 3436 - protein, 9 aa, Artificial Sequence
  Representative cyclic modulating agent based on Desmocollin cell adhesion recognition sequence
KFYVERDTD

SEQ ID NO: 3437 - protein, 10 aa, Artificial Sequence
  Representative cyclic modulating agent based on Desmocollin cell adhesion recognition sequence
KFYVERDTGD

SEQ ID NO: 3438 - protein, 9 aa, Artificial Sequence
  Representative cyclic modulating agent based on Desmocollin cell adhesion recognition sequence
KLFYVERDD

SEQ ID NO: 3439 - protein, 10 aa, Artificial Sequence
  Representative cyclic modulating agent based on Desmocollin cell adhesion recognition sequence
KLFYVERDTD

SEQ ID NO: 3440 - protein, 11 aa, Artificial Sequence
  Representative cyclic modulating agent based on Desmocollin cell adhesion recognition sequence
KLFYVERDTGD

SEQ ID NO: 3441 - protein, 6 aa, Artificial Sequence
  Representative cyclic modulating agent based on Desmocollin cell adhesion recognition sequence
KIERDD

SEQ ID NO: 3442 - protein, 7 aa, Artificial Sequence
  Representative cyclic modulating agent based on Desmocollin cell adhesion recognition sequence
KIERDTD

SEQ ID NO: 3443 - protein, 8 aa, Artificial Sequence
  Representative cyclic modulating agent based on Desmocollin cell adhesion recognition sequence
KIERDTGD

SEQ ID NO: 3444 - protein, 6 aa, Artificial Sequence
  Representative cyclic modulating agent based on Desmocollin cell adhesion recognition sequence
KYIERD

SEQ ID NO: 3445 - protein, 8 aa, Artificial Sequence
  Representative cyclic modulating agent based on Desmocollin cell adhesion recognition sequence
KYIERDTD

SEQ ID NO: 3446 - protein, 9 aa, Artificial Sequence
  Representative cyclic modulating agent based on Desmocollin cell adhesion recognition sequence
KYIERDTGD

SEQ ID NO: 3447 - protein, 8 aa, Artificial Sequence
  Representative cyclic modulating agent based on Desmocollin cell adhesion recognition sequence
KFYIERDD

SEQ ID NO: 3448 - protein, 9 aa, Artificial Sequence
  Representative cyclic modulating agent based on Desmocollin cell adhesion recognition sequence
KFYIERDTD

SEQ ID NO: 3449 - protein, 10 aa, Artificial Sequence
  Representative cyclic modulating agent based on Desmocollin cell adhesion recognition sequence
KFYIERDTGD

SEQ ID NO: 3450 - protein, 9 aa, Artificial Sequence
  Representative cyclic modulating agent based on Desmocollin cell adhesion recognition sequence
KLFYIERDD

SEQ ID NO: 3451 - protein, 10 aa, Artificial Sequence
  Representative cyclic modulating agent based on Desmocollin cell adhesion recognition sequence
KLFYIERDTD

SEQ ID NO: 3452 - protein, 11 aa, Artificial Sequence
  Representative cyclic modulating agent based on Desmocollin cell adhesion recognition sequence
KLFYIERDTGD

SEQ ID NO: 3453 - protein, 5 aa, Artificial Sequence
  Representative cyclic modulating agent based on Desmocollin cell adhesion recognition sequence
DEKDK

SEQ ID NO: 3454 - protein, 6 aa, Artificial Sequence
  Representative cyclic modulating agent based on Desmocollin cell adhesion recognition sequence
DEKDTK

SEQ ID NO: 3455 - protein, 7 aa, Artificial Sequence
  Representative cyclic modulating agent based on Desmocollin cell adhesion recognition sequence
DEKDTGK

SEQ ID NO: 3456 - protein, 6 aa, Artificial Sequence
  Representative cyclic modulating agent based on Desmocollin cell adhesion recognition sequence
DIEKDK

SEQ ID NO: 3457 - protein, 7 aa, Artificial Sequence
  Representative cyclic modulating agent based on Desmocollin cell adhesion recognition sequence
DIEKDTK

SEQ ID NO: 3458 - protein, 8 aa, Artificial Sequence
  Representative cyclic modulating agent based on Desmocollin cell adhesion recognition sequence
DIEKDTGK

SEQ ID NO: 3459 - protein, 7 aa, Artificial Sequence
  Representative cyclic modulating agent based on Desmocollin cell adhesion recognition sequence
DYIEKDK

SEQ ID NO: 3460 - protein, 8 aa, Artificial Sequence
  Representative cyclic modulating agent based on Desmocollin cell adhesion recognition sequence
DYIEKDTK

SEQ ID NO: 3461 - protein, 9 aa, Artificial Sequence
  Representative cyclic modulating agent based on Desmocollin cell adhesion recognition sequence
DYIEKDTGK

SEQ ID NO: 3462 - protein, 8 aa, Artificial Sequence
  Representative cyclic modulating agent based on Desmocollin cell adhesion recognition sequence
DFYIEKDK

SEQ ID NO: 3463 - protein, 9 aa, Artificial Sequence
  Representative cyclic modulating agent based on Desmocollin cell adhesion recognition sequence
DFYIEKDTK

SEQ ID NO: 3464 - protein, 10 aa, Artificial Sequence
  Representative cyclic modulating agent based on Desmocollin cell adhesion recognition sequence
DFYIEKDTGK

SEQ ID NO: 3465 - protein, 9 aa, Artificial Sequence
  Representative cyclic modulating agent based on Desmocollin cell adhesion recognition sequence
DLFYIEKDK

SEQ ID NO: 3466 - protein, 10 aa, Artificial Sequence
  Representative cyclic modulating agent based on Desmocollin cell adhesion recognition sequence
DLFYIEKDTK

SEQ ID NO: 3467 - protein, 11 aa, Artificial Sequence
  Representative cyclic modulating agent based on Desmocollin cell adhesion recognition sequence
DLFYIEKDTGK

SEQ ID NO: 3468 - protein, 5 aa, Artificial Sequence
  Representative cyclic modulating agent based on Desmocollin cell adhesion recognition sequence
DERDK

SEQ ID NO: 3469 - protein, 6 aa, Artificial Sequence
  Representative cyclic modulating agent based on Desmocollin cell adhesion recognition sequence
DERDTK

SEQ ID NO: 3470 - protein, 7 aa, Artificial Sequence
  Representative cyclic modulating agent based on Desmocollin cell adhesion recognition sequence
DERDTGK

SEQ ID NO: 3471 - protein, 6 aa, Artificial Sequence
  Representative cyclic modulating agent based on Desmocollin cell adhesion recognition sequence
DVERDK

SEQ ID NO: 3472 - protein, 7 aa, Artificial Sequence
  Representative cyclic modulating agent based on Desmocollin cell adhesion recognition sequence
DVERDTK

SEQ ID NO: 3473 - protein, 8 aa, Artificial Sequence
  Representative cyclic modulating agent based on Desmocollin cell adhesion recognition sequence
DVERDTGK

SEQ ID NO: 3474 - protein, 7 aa, Artificial Sequence
  Representative cyclic modulating agent based on Desmocollin cell adhesion recognition sequence
DYVERDK

SEQ ID NO: 3475 - protein, 8 aa, Artificial Sequence
  Representative cyclic modulating agent based on Desmocollin cell adhesion recognition sequence
DYVERDTK

SEQ ID NO: 3476 - protein, 9 aa, Artificial Sequence
  Representative cyclic modulating agent based on Desmocollin cell adhesion recognition sequence
DYVERDTGK

SEQ ID NO: 3477 - protein, 8 aa, Artificial Sequence
  Representative cyclic modulating agent based on Desmocollin cell adhesion recognition sequence
DFYVERDK

SEQ ID NO: 3478 - protein, 9 aa, Artificial Sequence
  Representative cyclic modulating agent based on Desmocollin cell adhesion recognition sequence
DFYVERDTK

SEQ ID NO: 3479 - protein, 10 aa, Artificial Sequence
  Representative cyclic modulating agent based on Desmocollin cell adhesion recognition sequence
DFYVERDTGK

SEQ ID NO: 3480 - protein, 9 aa, Artificial Sequence
  Representative cyclic modulating agent based on Desmocollin cell adhesion recognition sequence
DLFYVERDK

SEQ ID NO: 3481 - protein, 10 aa, Artificial Sequence
  Representative cyclic modulating agent based on Desmocollin cell adhesion recognition sequence
DLFYVERDTK

SEQ ID NO: 3482 - protein, 11 aa, Artificial Sequence
  Representative cyclic modulating agent based on Desmocollin cell adhesion recognition sequence
DLFYVERDTGK

SEQ ID NO: 3483 - protein, 6 aa, Artificial Sequence
  Representative cyclic modulating agent based on Desmocollin cell adhesion recognition sequence
DIERDK

SEQ ID NO: 3484 - protein, 7 aa, Artificial Sequence
  Representative cyclic modulating agent based on Desmocollin cell adhesion recognition sequence
DIERDTK

SEQ ID NO: 3485 - protein, 8 aa, Artificial Sequence
  Representative cyclic modulating agent based on Desmocollin cell adhesion recognition sequence
DIERDTGK

SEQ ID NO: 3486 - protein, 7 aa, Artificial Sequence
  Representative cyclic modulating agent based on Desmocollin cell adhesion recognition sequence
DYIERDK

SEQ ID NO: 3487 - protein, 8 aa, Artificial Sequence
  Representative cyclic modulating agent based on Desmocollin cell adhesion recognition sequence
DYIERDTK

SEQ ID NO: 3488 - protein, 9 aa, Artificial Sequence
  Representative cyclic modulating agent based on Desmocollin cell adhesion recognition sequence
DYIERDTGK

SEQ ID NO: 3489 - protein, 8 aa, Artificial Sequence
  Representative cyclic modulating agent based on Desmocollin cell adhesion recognition sequence
DFYIERDK

SEQ ID NO: 3490 - protein, 9 aa, Artificial Sequence
  Representative cyclic modulating agent based on Desmocollin cell adhesion recognition sequence
DFYIERDTK

SEQ ID NO: 3491 - protein, 10 aa, Artificial Sequence
  Representative cyclic modulating agent based on Desmocollin cell adhesion recognition sequence
DFYIERDTGK

SEQ ID NO: 3492 - protein, 9 aa, Artificial Sequence
  Representative cyclic modulating agent based on Desmocollin cell adhesion recognition sequence
DLFYIERDK

SEQ ID NO: 3493 - protein, 10 aa, Artificial Sequence
  Representative cyclic modulating agent based on Desmocollin cell adhesion recognition sequence
DLFYIERDTK

SEQ ID NO: 3494 - protein, 11 aa, Artificial Sequence
  Representative cyclic modulating agent based on Desmocollin cell adhesion recognition sequence
DLFYIERDTGK

SEQ ID NO: 3495 - protein, 5 aa, Artificial Sequence
  Representative cyclic modulating agent based on Desmocollin cell adhesion recognition sequence
KEKDE

SEQ ID NO: 3496 - protein, 6 aa, Artificial Sequence
  Representative cyclic modulating agent based on Desmocollin cell adhesion recognition sequence
KEKDTE

SEQ ID NO: 3497 - protein, 7 aa, Artificial Sequence
  Representative cyclic modulating agent based on Desmocollin cell adhesion recognition sequence
KEKDTGE

SEQ ID NO: 3498 - protein, 6 aa, Artificial Sequence
  Representative cyclic modulating agent based on Desmocollin cell adhesion recognition sequence
KIEKDE

SEQ ID NO: 3499 - protein, 7 aa, Artificial Sequence
  Representative cyclic modulating agent based on Desmocollin cell adhesion recognition sequence
KIEKDTE

SEQ ID NO: 3500 - protein, 8 aa, Artificial Sequence
  Representative cyclic modulating agent based on Desmocollin cell adhesion recognition sequence
KIEKDTGE

SEQ ID NO: 3501 - protein, 7 aa, Artificial Sequence
  Representative cyclic modulating agent based on Desmocollin cell adhesion recognition sequence
KYIEKDE

SEQ ID NO: 3502 - protein, 8 aa, Artificial Sequence
  Representative cyclic modulating agent based on Desmocollin cell adhesion recognition sequence
KYIEKDTE

SEQ ID NO: 3503 - protein, 9 aa, Artificial Sequence
  Representative cyclic modulating agent based on Desmocollin cell adhesion recognition sequence
KYIEKDTGE

SEQ ID NO: 3504 - protein, 8 aa, Artificial Sequence
  Representative cyclic modulating agent based on Desmocollin cell adhesion recognition sequence
KFYIEKDE

SEQ ID NO: 3505 - protein, 9 aa, Artificial Sequence
  Representative cyclic modulating agent based on Desmocollin cell adhesion recognition sequence
KFYIEKDTE

SEQ ID NO: 3506 - protein, 10 aa, Artificial Sequence
  Representative cyclic modulating agent based on Desmocollin cell adhesion recognition sequence
KFYIEKDTGE

SEQ ID NO: 3507 - protein, 9 aa, Artificial Sequence
  Representative cyclic modulating agent based on Desmocollin cell adhesion recognition sequence
KLFYIEKDE

SEQ ID NO: 3508 - protein, 10 aa, Artificial Sequence
  Representative cyclic modulating agent based on Desmocollin cell adhesion recognition sequence
KLFYIEKDTE

SEQ ID NO: 3509 - protein, 11 aa, Artificial Sequence
  Representative cyclic modulating agent based on Desmocollin cell adhesion recognition sequence
KLFYIEKDTGE

SEQ ID NO: 3510 - protein, 5 aa, Artificial Sequence
  Representative cyclic modulating agent based on Desmocollin cell adhesion recognition sequence
KERDE

SEQ ID NO: 3511 - protein, 6 aa, Artificial Sequence
  Representative cyclic modulating agent based on Desmocollin cell adhesion recognition sequence
KERDTE

SEQ ID NO: 3512 - protein, 7 aa, Artificial Sequence
  Representative cyclic modulating agent based on Desmocollin cell adhesion recognition sequence
KERDTGE

SEQ ID NO: 3513 - protein, 6 aa, Artificial Sequence
  Representative cyclic modulating agent based on Desmocollin cell adhesion recognition sequence
KVERDE

SEQ ID NO: 3514 - protein, 7 aa, Artificial Sequence
  Representative cyclic modulating agent based on Desmocollin cell adhesion recognition sequence
KVERDTE

SEQ ID NO: 3515 - protein, 8 aa, Artificial Sequence
  Representative cyclic modulating agent based on Desmocollin cell adhesion recognition sequence
KVERDTGE

SEQ ID NO: 3516 - protein, 7 aa, Artificial Sequence
  Representative cyclic modulating agent based on Desmocollin cell adhesion recognition sequence
KYVERDE

SEQ ID NO: 3517 - protein, 8 aa, Artificial Sequence
  Representative cyclic modulating agent based on Desmocollin cell adhesion recognition sequence
KYVERDTE

SEQ ID NO: 3518 - protein, 9 aa, Artificial Sequence
  Representative cyclic modulating agent based on Desmocollin cell adhesion recognition sequence
KYVERDTGE

SEQ ID NO: 3519 - protein, 8 aa, Artificial Sequence
  Representative cyclic modulating agent based on Desmocollin cell adhesion recognition sequence
KFYVERDE

SEQ ID NO: 3520 - protein, 9 aa, Artificial Sequence
  Representative cyclic modulating agent based on Desmocollin cell adhesion recognition sequence
KFYVERDTE

SEQ ID NO: 3521 - protein, 10 aa, Artificial Sequence
  Representative cyclic modulating agent based on Desmocollin cell adhesion recognition sequence
KFYVERDTGE

SEQ ID NO: 3522 - protein, 9 aa, Artificial Sequence
  Representative cyclic modulating agent based on Desmocollin cell adhesion recognition sequence
KLFYVERDE

SEQ ID NO: 3523 - protein, 10 aa, Artificial Sequence
  Representative cyclic modulating agent based on Desmocollin cell adhesion recognition sequence
KLFYVERDTE

SEQ ID NO: 3524 - protein, 11 aa, Artificial Sequence
  Representative cyclic modulating agent based on Desmocollin cell adhesion recognition sequence
KLFYVERDTGE

SEQ ID NO: 3525 - protein, 6 aa, Artificial Sequence
  Representative cyclic modulating agent based on Desmocollin cell adhesion recognition sequence
KIERDE

SEQ ID NO: 3526 - protein, 7 aa, Artificial Sequence
  Representative cyclic modulating agent based on Desmocollin cell adhesion recognition sequence
KIERDTE

SEQ ID NO: 3527 - protein, 8 aa, Artificial Sequence
  Representative cyclic modulating agent based on Desmocollin cell adhesion recognition sequence
KIERDTGE

SEQ ID NO: 3528 - protein, 7 aa, Artificial Sequence
  Representative cyclic modulating agent based on Desmocollin cell adhesion recognition sequence
KYIERDE

SEQ ID NO: 3529 - protein, 8 aa, Artificial Sequence
  Representative cyclic modulating agent based on Desmocollin cell adhesion recognition sequence
KYIERDTE

SEQ ID NO: 3530 - protein, 9 aa, Artificial Sequence
  Representative cyclic modulating agent based on Desmocollin cell adhesion recognition sequence
KYIERDTGE

SEQ ID NO: 3531 - protein, 8 aa, Artificial Sequence
  Representative cyclic modulating agent based on Desmocollin cell adhesion recognition sequence
KFYIERDE

SEQ ID NO: 3532 - protein, 9 aa, Artificial Sequence
  Representative cyclic modulating agent based on Desmocollin cell adhesion recognition sequence
KFYIERDTE

SEQ ID NO: 3533 - protein, 10 aa, Artificial Sequence
  Representative cyclic modulating agent based on Desmocollin cell adhesion recognition sequence
KFYIERDTGE

SEQ ID NO: 3534 - protein, 9 aa, Artificial Sequence
  Representative cyclic modulating agent based on Desmocollin cell adhesion recognition sequence
KLFYIERDE

SEQ ID NO: 3535 - protein, 10 aa, Artificial Sequence
  Representative cyclic modulating agent based on Desmocollin cell adhesion recognition sequence
KLFYIERDTE

SEQ ID NO: 3536 - protein, 11 aa, Artificial Sequence
  Representative cyclic modulating agent based on Desmocollin cell adhesion recognition sequence
KLFYIERDTGE

SEQ ID NO: 3537 - protein, 5 aa, Artificial Sequence
  Representative cyclic modulating agent based on Desmocollin cell adhesion recognition sequence
EKDTG

SEQ ID NO: 3538 - protein, 5 aa, Artificial Sequence
  Representative cyclic modulating agent based on Desmocollin cell adhesion recognition sequence
IEKDT

SEQ ID NO: 3539 - protein, 6 aa, Artificial Sequence
  Representative cyclic modulating agent based on Desmocollin cell adhesion recognition sequence
IEKDTG

SEQ ID NO: 3540 - protein, 5 aa, Artificial Sequence
  Representative cyclic modulating agent based on Desmocollin cell adhesion recognition sequence
YIEKD

SEQ ID NO: 3541 - protein, 6 aa, Artificial Sequence
  Representative cyclic modulating agent based on Desmocollin cell adhesion recognition sequence
YIEKDT

SEQ ID NO: 3542 - protein, 7 aa, Artificial Sequence
  Representative cyclic modulating agent based on Desmocollin cell adhesion recognition sequence
YIEKDTG

SEQ ID NO: 3543 - protein, 6 aa, Artificial Sequence
  Representative cyclic modulating agent based on Desmocollin cell adhesion recognition sequence
FYIEKD

SEQ ID NO: 3544 - protein, 7 aa, Artificial Sequence
  Representative cyclic modulating agent based on Desmocollin cell adhesion recognition sequence
FYIEKDT

SEQ ID NO: 3545 - protein, 8 aa, Artificial Sequence
  Representative cyclic modulating agent based on Desmocollin cell adhesion recognition sequence
FYIEKDTG

SEQ ID NO: 3546 - protein, 7 aa, Artificial Sequence
  Representative cyclic modulating agent based on Desmocollin cell adhesion recognition sequence
LFYIEKD

SEQ ID NO: 3547 - protein, 8 aa, Artificial Sequence
  Representative cyclic modulating agent based on Desmocollin cell adhesion recognition sequence
LFYIEKDT

SEQ ID NO: 3548 - protein, 9 aa, Artificial Sequence
  Representative cyclic modulating agent based on Desmocollin cell adhesion recognition sequence
LFYIEKDTG

SEQ ID NO: 3549 - protein, 5 aa, Artificial Sequence
  Representative cyclic modulating agent based on Desmocollin cell adhesion recognition sequence
ERDTG

SEQ ID NO: 3550 - protein, 5 aa, Artificial Sequence
  Representative cyclic modulating agent based on Desmocollin cell adhesion recognition sequence
VERDT

SEQ ID NO: 3551 - protein, 6 aa, Artificial Sequence
  Representative cyclic modulating agent based on Desmocollin cell adhesion recognition sequence
VERDTG

SEQ ID NO: 3552 - protein, 5 aa, Artificial Sequence
  Representative cyclic modulating agent based on Desmocollin cell adhesion recognition sequence
YVERD

SEQ ID NO: 3553 - protein, 6 aa, Artificial Sequence
  Representative cyclic modulating agent based on Desmocollin cell adhesion recognition sequence
YVERDT

SEQ ID NO: 3554 - protein, 7 aa, Artificial Sequence
  Representative cyclic modulating agent based on Desmocollin cell adhesion recognition sequence
YVERDTG

SEQ ID NO: 3555 - protein, 6 aa, Artificial Sequence
  Representative cyclic modulating agent based on Desmocollin cell adhesion recognition sequence
FYVERD

SEQ ID NO: 3556 - protein, 7 aa, Artificial Sequence
  Representative cyclic modulating agent based on Desmocollin cell adhesion recognition sequence
FYVERDT

SEQ ID NO: 3557 - protein, 8 aa, Artificial Sequence
  Representative cyclic modulating agent based on Desmocollin cell adhesion recognition sequence
FYVERDTG

SEQ ID NO: 3558 - protein, 7 aa, Artificial Sequence
  Representative cyclic modulating agent based on Desmocollin cell adhesion recognition sequence
LFYVERD

SEQ ID NO: 3559 - protein, 8 aa, Artificial Sequence
  Representative cyclic modulating agent based on Desmocollin cell adhesion recognition sequence
LFYVERDT

SEQ ID NO: 3560 - protein, 9 aa, Artificial Sequence
  Representative cyclic modulating agent based on Desmocollin cell adhesion recognition sequence
LFYVERDTG

SEQ ID NO: 3561 - protein, 5 aa, Artificial Sequence
  Representative cyclic modulating agent based on Desmocollin cell adhesion recognition sequence
IERDT

SEQ ID NO: 3562 - protein, 6 aa, Artificial Sequence
  Representative cyclic modulating agent based on Desmocollin cell adhesion recognition sequence
IERDTG

SEQ ID NO: 3563 - protein, 5 aa, Artificial Sequence
  Representative cyclic modulating agent based on Desmocollin cell adhesion recognition sequence
YIERD

SEQ ID NO: 3564 - protein, 6 aa, Artificial Sequence
  Representative cyclic modulating agent based on Desmocollin cell adhesion recognition sequence
YIERDT

SEQ ID NO: 3565 - protein, 7 aa, Artificial Sequence
  Representative cyclic modulating agent based on Desmocollin cell adhesion recognition sequence
YIERDTG

SEQ ID NO: 3566 - protein, 6 aa, Artificial Sequence
  Representative cyclic modulating agent based on Desmocollin cell adhesion recognition sequence
FYIERD

SEQ ID NO: 3567 - protein, 7 aa, Artificial Sequence
  Representative cyclic modulating agent based on Desmocollin cell adhesion recognition sequence
FYIERDT

SEQ ID NO: 3568 - protein, 8 aa, Artificial Sequence
  Representative cyclic modulating agent based on Desmocollin cell adhesion recognition sequence
FYIERDTG

SEQ ID NO: 3569 - protein, 7 aa, Artificial Sequence
  Representative cyclic modulating agent based on Desmocollin cell adhesion recognition sequence
LFYIERD

SEQ ID NO: 3570 - protein, 8 aa, Artificial Sequence
  Representative cyclic modulating agent based on Desmocollin cell adhesion recognition sequence
LFYIERDT

SEQ ID NO: 3571 - protein, 9 aa, Artificial Sequence
  Representative cyclic modulating agent based on Desmocollin cell adhesion recognition sequence
LFYIERDTG

SEQ ID NO: 3572 - protein, 5 aa, Artificial Sequence
  Representative cyclic modulating agent based on cadherin-related neuronal receptor cell adhesion recognition sequence
CDPVC

SEQ ID NO: 3573 - protein, 6 aa, Artificial Sequence
  Representative cyclic modulating agent based on cadherin-related neuronal receptor cell adhesion recognition sequence
CDPVSC

SEQ ID NO: 3574 - protein, 7 aa, Artificial Sequence
  Representative cyclic modulating agent based on cadherin-related neuronal receptor cell adhesion recognition sequence
CDPVSGC

SEQ ID NO: 3575 - protein, 6 aa, Artificial Sequence
  Representative cyclic modulating agent based on cadherin-related neuronal receptor cell adhesion recognition sequence
CIDPVC

SEQ ID NO: 3576 - protein, 7 aa, Artificial Sequence
  Representative cyclic modulating agent based on cadherin-related neuronal receptor cell adhesion recognition sequence
CIDPVSC

SEQ ID NO: 3577 - protein, 8 aa, Artificial Sequence
  Representative cyclic modulating agent based on cadherin-related neuronal receptor cell adhesion recognition sequence
CIDPVSGC

SEQ ID NO: 3578 - protein, 7 aa, Artificial Sequence
  Representative cyclic modulating agent based on cadherin-related neuronal receptor cell adhesion recognition sequence
CHIDPVC

SEQ ID NO: 3579 - protein, 8 aa, Artificial Sequence
  Representative cyclic modulating agent based on cadherin-related neuronal receptor cell adhesion recognition sequence
CHIDPVSC

SEQ ID NO: 3580 - protein, 9 aa, Artificial Sequence
  Representative cyclic modulating agent based on cadherin-related neuronal receptor cell adhesion recognition sequence
CHIDPVSGC

SEQ ID NO: 3581 - protein, 8 aa, Artificial Sequence
  Representative cyclic modulating agent based on cadherin-related neuronal receptor cell adhesion recognition sequence
CFHIDPVC

SEQ ID NO: 3582 - protein, 9 aa, Artificial Sequence
  Representative cyclic modulating agent based on cadherin-related neuronal receptor cell adhesion recognition sequence
CFHIDPVSC

SEQ ID NO: 3583 - protein, 10 aa, Artificial Sequence
  Representative cyclic modulating agent based on cadherin-related neuronal receptor cell adhesion recognition sequence
CFHIDPVSGC

SEQ ID NO: 3584 - protein, 9 aa, Artificial Sequence
  Representative cyclic modulating agent based on cadherin-related neuronal receptor cell adhesion recognition sequence
CKFHIDPVC

SEQ ID NO: 3585 - protein, 10 aa, Artificial Sequence
  Representative cyclic modulating agent based on cadherin-related neuronal receptor cell adhesion recognition sequence
CKFHIDPVSC

SEQ ID NO: 3586 - protein, 11 aa, Artificial Sequence
  Representative cyclic modulating agent based on cadherin-related neuronal receptor cell adhesion recognition sequence
CKFHIDPVSGC

SEQ ID NO: 3587 - protein, 5 aa, Artificial Sequence
  Representative cyclic modulating agent based on cadherin-related neuronal receptor cell adhesion recognition sequence
CDADC

SEQ ID NO: 3588 - protein, 6 aa, Artificial Sequence
  Representative cyclic modulating agent based on cadherin-related neuronal receptor cell adhesion recognition sequence
CDADTC

SEQ ID NO: 3589 - protein, 7 aa, Artificial Sequence
  Representative cyclic modulating agent based on cadherin-related neuronal receptor cell adhesion recognition sequence
CDADTGC

SEQ ID NO: 3590 - protein, 7 aa, Artificial Sequence
  Representative cyclic modulating agent based on cadherin-related neuronal receptor cell adhesion recognition sequence
CIDADTC

SEQ ID NO: 3591 - protein, 6 aa, Artificial Sequence
  Representative cyclic modulating agent based on cadherin-related neuronal receptor cell adhesion recognition sequence
CIDADC

SEQ ID NO: 3592 - protein, 8 aa, Artificial Sequence
  Representative cyclic modulating agent based on cadherin-related neuronal receptor cell adhesion recognition sequence
CIDADTGC

SEQ ID NO: 3593 - protein, 7 aa, Artificial Sequence
  Representative cyclic modulating agent based on cadherin-related neuronal receptor cell adhesion recognition sequence
CSIDADC

SEQ ID NO: 3594 - protein, 8 aa, Artificial Sequence
  Representative cyclic modulating agent based on cadherin-related neuronal receptor cell adhesion recognition sequence
CSIDADTC

SEQ ID NO: 3595 - protein, 9 aa, Artificial Sequence
  Representative cyclic modulating agent based on cadherin-related neuronal receptor cell adhesion recognition sequence
CSIDADTGC

SEQ ID NO: 3596 - protein, 8 aa, Artificial Sequence
  Representative cyclic modulating agent based on cadherin-related neuronal receptor cell adhesion recognition sequence
CFSIDADC

SEQ ID NO: 3597 - protein, 9 aa, Artificial Sequence
  Representative cyclic modulating agent based on cadherin-related neuronal receptor cell adhesion recognition sequence
CFSIDADTC

SEQ ID NO: 3598 - protein, 10 aa, Artificial Sequence
  Representative cyclic modulating agent based on cadherin-related neuronal receptor cell adhesion recognition sequence
CFSIDADTGC

SEQ ID NO: 3599 - protein, 9 aa, Artificial Sequence
  Representative cyclic modulating agent based on cadherin-related neuronal receptor cell adhesion recognition sequence
CQFSIDADC

SEQ ID NO: 3600 - protein, 10 aa, Artificial Sequence
  Representative cyclic modulating agent based on cadherin-related neuronal receptor cell adhesion recognition sequence
CQFSIDADTC

SEQ ID NO: 3601 - protein, 11 aa, Artificial Sequence
  Representative cyclic modulating agent based on cadherin-related neuronal receptor cell adhesion recognition sequence
CQFSIDADTGC

SEQ ID NO: 3602 - protein, 5 aa, Artificial Sequence
  Representative cyclic modulating agent based on cadherin-related neuronal receptor cell adhesion recognition sequence
CDSVC

SEQ ID NO: 3603 - protein, 6 aa, Artificial Sequence
  Representative cyclic modulating agent based on cadherin-related neuronal receptor cell adhesion recognition sequence
CDSVSC

SEQ ID NO: 3604 - protein, 7 aa, Artificial Sequence
  Representative cyclic modulating agent based on cadherin-related neuronal receptor cell adhesion recognition sequence
CDSVSGC

SEQ ID NO: 3605 - protein, 6 aa, Artificial Sequence
  Representative cyclic modulating agent based on cadherin-related neuronal receptor cell adhesion recognition sequence
CIDSVC

SEQ ID NO: 3606 - protein, 7 aa, Artificial Sequence
  Representative cyclic modulating agent based on cadherin-related neuronal receptor cell adhesion recognition sequence
CIDSVSC

SEQ ID NO: 3607 - protein, 8 aa, Artificial Sequence
  Representative cyclic modulating agent based on cadherin-related neuronal receptor cell adhesion recognition sequence
CIDSVSGC

SEQ ID NO: 3608 - protein, 7 aa, Artificial Sequence
  Representative cyclic modulating agent based on cadherin-related neuronal receptor cell adhesion recognition sequence
CHIDSVC

SEQ ID NO: 3609 - protein, 8 aa, Artificial Sequence
  Representative cyclic modulating agent based on cadherin-related neuronal receptor cell adhesion recognition sequence
CHIDSVSC

SEQ ID NO: 3610 - protein, 9 aa, Artificial Sequence
  Representative cyclic modulating agent based on cadherin-related neuronal receptor cell adhesion recognition sequence
CHIDSVSGC

SEQ ID NO: 3611 - protein, 8 aa, Artificial Sequence
  Representative cyclic modulating agent based on cadherin-related neuronal receptor cell adhesion recognition sequence
CFHIDSVC

SEQ ID NO: 3612 - protein, 9 aa, Artificial Sequence
  Representative cyclic modulating agent based on cadherin-related neuronal receptor cell adhesion recognition sequence
CFHIDSVSC

SEQ ID NO: 3613 - protein, 10 aa, Artificial Sequence
  Representative cyclic modulating agent based on cadherin-related neuronal receptor cell adhesion recognition sequence
CFHIDSVSGC

SEQ ID NO: 3614 - protein, 9 aa, Artificial Sequence
  Representative cyclic modulating agent based on cadherin-related neuronal receptor cell adhesion recognition sequence
CTFHIDSVC

SEQ ID NO: 3615 - protein, 10 aa, Artificial Sequence
  Representative cyclic modulating agent based on cadherin-related neuronal receptor cell adhesion recognition sequence
CTFHIDSVSC

SEQ ID NO: 3616 - protein, 11 aa, Artificial Sequence
  Representative cyclic modulating agent based on cadherin-related neuronal receptor cell adhesion recognition sequence
CTFHIDSVSGC

SEQ ID NO: 3617 - protein, 5 aa, Artificial Sequence
  Representative cyclic modulating agent based on cadherin-related neuronal receptor cell adhesion recognition sequence
CDSNC

SEQ ID NO: 3618 - protein, 6 aa, Artificial Sequence
  Representative cyclic modulating agent based on cadherin-related neuronal receptor cell adhesion recognition sequence
CDSNSC

SEQ ID NO: 3619 - protein, 7 aa, Artificial Sequence
  Representative cyclic modulating agent based on cadherin-related neuronal receptor cell adhesion recognition sequence
CDSNSGC

SEQ ID NO: 3620 - protein, 6 aa, Artificial Sequence
  Representative cyclic modulating agent based on cadherin-related neuronal receptor cell adhesion recognition sequence
CIDSNC

SEQ ID NO: 3621 - protein, 7 aa, Artificial Sequence
  Representative cyclic modulating agent based on cadherin-related neuronal receptor cell adhesion recognition sequence
CIDSNSC

SEQ ID NO: 3622 - protein, 8 aa, Artificial Sequence
  Representative cyclic modulating agent based on cadherin-related neuronal receptor cell adhesion recognition sequence
CIDSNSGC

SEQ ID NO: 3623 - protein, 7 aa, Artificial Sequence
  Representative cyclic modulating agent based on cadherin-related neuronal receptor cell adhesion recognition sequence
CNIDSNC

SEQ ID NO: 3624 - protein, 8 aa, Artificial Sequence
  Representative cyclic modulating agent based on cadherin-related neuronal receptor cell adhesion recognition sequence
CNIDSNSC

SEQ ID NO: 3625 - protein, 9 aa, Artificial Sequence
  Representative cyclic modulating agent based on cadherin-related neuronal receptor cell adhesion recognition sequence
CNIDSNSGC

SEQ ID NO: 3626 - protein, 8 aa, Artificial Sequence
  Representative cyclic modulating agent based on cadherin-related neuronal receptor cell adhesion recognition sequence
CFNIDSNC

SEQ ID NO: 3627 - protein, 9 aa, Artificial Sequence
  Representative cyclic modulating agent based on cadherin-related neuronal receptor cell adhesion recognition sequence
CFNIDSNSC

SEQ ID NO: 3628 - protein, 10 aa, Artificial Sequence
  Representative cyclic modulating agent based on cadherin-related neuronal receptor cell adhesion recognition sequence
CFNIDSNSGC

SEQ ID NO: 3629 - protein, 9 aa, Artificial Sequence
  Representative cyclic modulating agent based on cadherin-related neuronal receptor cell adhesion recognition sequence
CAFNIDSNC

SEQ ID NO: 3630 - protein, 7 aa, Artificial Sequence
  Representative cyclic modulating agent based on cadherin-related neuronal receptor cell adhesion recognition sequence
EINENTK

SEQ ID NO: 3631 - protein, 10 aa, Artificial Sequence
  Representative cyclic modulating agent based on cadherin-related neuronal receptor cell adhesion recognition sequence
CAFNIDSNSC

SEQ ID NO: 3632 - protein, 11 aa, Artificial Sequence
  Representative cyclic modulating agent based on cadherin-related neuronal receptor cell adhesion recognition sequence
CAFNIDSNSGC

SEQ ID NO: 3633 - protein, 5 aa, Artificial Sequence
  Representative cyclic modulating agent based on cadherin-related neuronal receptor cell adhesion recognition sequence
CDSSC

SEQ ID NO: 3634 - protein, 6 aa, Artificial Sequence
  Representative cyclic modulating agent based on cadherin-related neuronal receptor cell adhesion recognition sequence
CDSSSC

SEQ ID NO: 3635 - protein, 7 aa, Artificial Sequence
  Representative cyclic modulating agent based on cadherin-related neuronal receptor cell adhesion recognition sequence
CDSSSGC

SEQ ID NO: 3636 - protein, 6 aa, Artificial Sequence
  Representative cyclic modulating agent based on cadherin-related neuronal receptor cell adhesion recognition sequence
CIDSSC

SEQ ID NO: 3637 - protein, 7 aa, Artificial Sequence
  Representative cyclic modulating agent based on cadherin-related neuronal receptor cell adhesion recognition sequence
CIDSSSC

SEQ ID NO: 3638 - protein, 8 aa, Artificial Sequence
  Representative cyclic modulating agent based on cadherin-related neuronal receptor cell adhesion recognition sequence
CIDSSSGC

SEQ ID NO: 3639 - protein, 7 aa, Artificial Sequence
  Representative cyclic modulating agent based on cadherin-related neuronal receptor cell adhesion recognition sequence
CTIDSSC

SEQ ID NO: 3640 - protein, 8 aa, Artificial Sequence
  Representative cyclic modulating agent based on cadherin-related neuronal receptor cell adhesion recognition sequence
CTIDSSSC

SEQ ID NO: 3641 - protein, 9 aa, Artificial Sequence
  Representative cyclic modulating agent based on cadherin-related neuronal receptor cell adhesion recognition sequence
CTIDSSSGC

SEQ ID NO: 3642 - protein, 8 aa, Artificial Sequence
  Representative cyclic modulating agent based on cadherin-related neuronal receptor cell adhesion recognition sequence
CFTIDSSC

SEQ ID NO: 3643 - protein, 9 aa, Artificial Sequence
  Representative cyclic modulating agent based on cadherin-related neuronal receptor cell adhesion recognition sequence
CFTIDSSSC

SEQ ID NO: 3644 - protein, 10 aa, Artificial Sequence
  Representative cyclic modulating agent based on cadherin-related neuronal receptor cell adhesion recognition sequence
CFTIDSSSGC

SEQ ID NO: 3645 - protein, 9 aa, Artificial Sequence
  Representative cyclic modulating agent based on cadherin-related neuronal receptor cell adhesion recognition sequence
CKFTIDSSC

SEQ ID NO: 3646 - protein, 10 aa, Artificial Sequence
  Representative cyclic modulating agent based on cadherin-related neuronal receptor cell adhesion recognition sequence
CKFTIDSSSC

SEQ ID NO: 3647 - protein, 11 aa, Artificial Sequence
  Representative cyclic modulating agent based on cadherin-related neuronal receptor cell adhesion recognition sequence
CKFTIDSSSGC

SEQ ID NO: 3648 - protein, 5 aa, Artificial Sequence
  Representative cyclic modulating agent based on cadherin-related neuronal receptor cell adhesion recognition sequence
CDEKC

SEQ ID NO: 3649 - protein, 6 aa, Artificial Sequence
  Representative cyclic modulating agent based on cadherin-related neuronal receptor cell adhesion recognition sequence
CDEKNC

SEQ ID NO: 3650 - protein, 7 aa, Artificial Sequence
  Representative cyclic modulating agent based on cadherin-related neuronal receptor cell adhesion recognition sequence
CDEKNGC

SEQ ID NO: 3651 - protein, 6 aa, Artificial Sequence
  Representative cyclic modulating agent based on cadherin-related neuronal receptor cell adhesion recognition sequence
CLDEKC

SEQ ID NO: 3652 - protein, 7 aa, Artificial Sequence
  Representative cyclic modulating agent based on cadherin-related neuronal receptor cell adhesion recognition sequence
CLDEKNC

SEQ ID NO: 3653 - protein, 8 aa, Artificial Sequence
  Representative cyclic modulating agent based on cadherin-related neuronal receptor cell adhesion recognition sequence
CLDEKNGC

SEQ ID NO: 3654 - protein, 7 aa, Artificial Sequence
  Representative cyclic modulating agent based on cadherin-related neuronal receptor cell adhesion recognition sequence
CTLDEKC

SEQ ID NO: 3655 - protein, 8 aa, Artificial Sequence
  Representative cyclic modulating agent based on cadherin-related neuronal receptor cell adhesion recognition sequence
CTLDEKNC

SEQ ID NO: 3656 - protein, 9 aa, Artificial Sequence
  Representative cyclic modulating agent based on cadherin-related neuronal receptor cell adhesion recognition sequence
CTLDEKNGC

SEQ ID NO: 3657 - protein, 8 aa, Artificial Sequence
  Representative cyclic modulating agent based on cadherin-related neuronal receptor cell adhesion recognition sequence
CFTLDEKC

SEQ ID NO: 3658 - protein, 9 aa, Artificial Sequence
  Representative cyclic modulating agent based on cadherin-related neuronal receptor cell adhesion recognition sequence
CFTLDEKNC

SEQ ID NO: 3659 - protein, 10 aa, Artificial Sequence
  Representative cyclic modulating agent based on cadherin-related neuronal receptor cell adhesion recognition sequence
CFTLDEKNGC

SEQ ID NO: 3660 - protein, 9 aa, Artificial Sequence
  Representative cyclic modulating agent based on cadherin-related neuronal receptor cell adhesion recognition sequence
CLFTLDEKC

SEQ ID NO: 3661 - protein, 10 aa, Artificial Sequence
  Representative cyclic modulating agent based on cadherin-related neuronal receptor cell adhesion recognition sequence
CLFTLDEKNC

SEQ ID NO: 3662 - protein, 11 aa, Artificial Sequence
  Representative cyclic modulating agent based on cadherin-related neuronal receptor cell adhesion recognition sequence
CLFTLDEKNGC

SEQ ID NO: 3663 - protein, 5 aa, Artificial Sequence
  Representative cyclic modulating agent based on cadherin-related neuronal receptor cell adhesion recognition sequence
CNEKC

SEQ ID NO: 3664 - protein, 6 aa, Artificial Sequence
  Representative cyclic modulating agent based on cadherin-related neuronal receptor cell adhesion recognition sequence
CNEKTC

SEQ ID NO: 3665 - protein, 7 aa, Artificial Sequence
  Representative cyclic modulating agent based on cadherin-related neuronal receptor cell adhesion recognition sequence
CNEKTGC

SEQ ID NO: 3666 - protein, 6 aa, Artificial Sequence
  Representative cyclic modulating agent based on cadherin-related neuronal receptor cell adhesion recognition sequence
CINEKC

SEQ ID NO: 3667 - protein, 7 aa, Artificial Sequence
  Representative cyclic modulating agent based on cadherin-related neuronal receptor cell adhesion recognition sequence
CINEKTC

SEQ ID NO: 3668 - protein, 8 aa, Artificial Sequence
  Representative cyclic modulating agent based on cadherin-related neuronal receptor cell adhesion recognition sequence
CINEKTGC

SEQ ID NO: 3669 - protein, 7 aa, Artificial Sequence
  Representative cyclic modulating agent based on cadherin-related neuronal receptor cell adhesion recognition sequence
CLINEKC

SEQ ID NO: 3670 - protein, 8 aa, Artificial Sequence
  Representative cyclic modulating agent based on cadherin-related neuronal receptor cell adhesion recognition sequence
CLINEKTC

SEQ ID NO: 3671 - protein, 9 aa, Artificial Sequence
  Representative cyclic modulating agent based on cadherin-related neuronal receptor cell adhesion recognition sequence
CLINEKTGC

SEQ ID NO: 3672 - protein, 8 aa, Artificial Sequence
  Representative cyclic modulating agent based on cadherin-related neuronal receptor cell adhesion recognition sequence
CFLINEKC

SEQ ID NO: 3673 - protein, 9 aa, Artificial Sequence
  Representative cyclic modulating agent based on cadherin-related neuronal receptor cell adhesion recognition sequence
CFLINEKTC

SEQ ID NO: 3674 - protein, 10 aa, Artificial Sequence
  Representative cyclic modulating agent based on cadherin-related neuronal receptor cell adhesion recognition sequence
CFLINEKTGC

SEQ ID NO: 3675 - protein, 9 aa, Artificial Sequence
  Representative cyclic modulating agent based on cadherin-related neuronal receptor cell adhesion recognition sequence
CKFLINEKC

SEQ ID NO: 3676 - protein, 10 aa, Artificial Sequence
  Representative cyclic modulating agent based on cadherin-related neuronal receptor cell adhesion recognition sequence
CKFLINEKTC

SEQ ID NO: 3677 - protein, 11 aa, Artificial Sequence
  Representative cyclic modulating agent based on cadherin-related neuronal receptor cell adhesion recognition sequence
CKFLINEKTGC

SEQ ID NO: 3678 - protein, 5 aa, Artificial Sequence
  Representative cyclic modulating agent based on cadherin-related neuronal receptor cell adhesion recognition sequence
EDPVK

SEQ ID NO: 3679 - protein, 6 aa, Artificial Sequence
  Representative cyclic modulating agent based on cadherin-related neuronal receptor cell adhesion recognition sequence
EDPVSK

SEQ ID NO: 3680 - protein, 7 aa, Artificial Sequence
  Representative cyclic modulating agent based on cadherin-related neuronal receptor cell adhesion recognition sequence
EDPVSGK

SEQ ID NO: 3681 - protein, 6 aa, Artificial Sequence
  Representative cyclic modulating agent based on cadherin-related neuronal receptor cell adhesion recognition sequence
EIDPVK

SEQ ID NO: 3682 - protein, 7 aa, Artificial Sequence
  Representative cyclic modulating agent based on cadherin-related neuronal receptor cell adhesion recognition sequence
EIDPVSK

SEQ ID NO: 3683 - protein, 8 aa, Artificial Sequence
  Representative cyclic modulating agent based on cadherin-related neuronal receptor cell adhesion recognition sequence
EIDPVSGK

SEQ ID NO: 3684 - protein, 7 aa, Artificial Sequence
  Representative cyclic modulating agent based on cadherin-related neuronal receptor cell adhesion recognition sequence
EHIDPVK

SEQ ID NO: 3685 - protein, 8 aa, Artificial Sequence
  Representative cyclic modulating agent based on cadherin-related neuronal receptor cell adhesion recognition sequence
EHIDPVSK

SEQ ID NO: 3686 - protein, 9 aa, Artificial Sequence
  Representative cyclic modulating agent based on cadherin-related neuronal receptor cell adhesion recognition sequence
EHIDPVSGK

SEQ ID NO: 3687 - protein, 8 aa, Artificial Sequence
  Representative cyclic modulating agent based on cadherin-related neuronal receptor cell adhesion recognition sequence
EFHIDPVK

SEQ ID NO: 3688 - protein, 9 aa, Artificial Sequence
  Representative cyclic modulating agent based on cadherin-related neuronal receptor cell adhesion recognition sequence
EFHIDPVSK

SEQ ID NO: 3689 - protein, 10 aa, Artificial Sequence
  Representative cyclic modulating agent based on cadherin-related neuronal receptor cell adhesion recognition sequence
EFHIDPVSGK

SEQ ID NO: 3690 - protein, 9 aa, Artificial Sequence
  Representative cyclic modulating agent based on cadherin-related neuronal receptor cell adhesion recognition sequence
EKFHIDPVK

SEQ ID NO: 3691 - protein, 10 aa, Artificial Sequence
  Representative cyclic modulating agent based on cadherin-related neuronal receptor cell adhesion recognition sequence
EKFHIDPVSK

SEQ ID NO: 3692 - protein, 11 aa, Artificial Sequence
  Representative cyclic modulating agent based on cadherin-related neuronal receptor cell adhesion recognition sequence
EKFHIDPVSGK

SEQ ID NO: 3693 - protein, 5 aa, Artificial Sequence
  Representative cyclic modulating agent based on cadherin-related neuronal receptor cell adhesion recognition sequence
EDADK

SEQ ID NO: 3694 - protein, 6 aa, Artificial Sequence
  Representative cyclic modulating agent based on cadherin-related neuronal receptor cell adhesion recognition sequence
EDADTK

SEQ ID NO: 3695 - protein, 7 aa, Artificial Sequence
  Representative cyclic modulating agent based on cadherin-related neuronal receptor cell adhesion recognition sequence
EDADTGK

SEQ ID NO: 3696 - protein, 6 aa, Artificial Sequence
  Representative cyclic modulating agent based on cadherin-related neuronal receptor cell adhesion recognition sequence
EIDADK

SEQ ID NO: 3697 - protein, 7 aa, Artificial Sequence
  Representative cyclic modulating agent based on cadherin-related neuronal receptor cell adhesion recognition sequence
EIDADTK

SEQ ID NO: 3698 - protein, 8 aa, Artificial Sequence
  Representative cyclic modulating agent based on cadherin-related neuronal receptor cell adhesion recognition sequence
EIDADTGK

SEQ ID NO: 3699 - protein, 7 aa, Artificial Sequence
  Representative cyclic modulating agent based on cadherin-related neuronal receptor cell adhesion recognition sequence
ESIDADK

SEQ ID NO: 3700 - protein, 8 aa, Artificial Sequence
  Representative cyclic modulating agent based on cadherin-related neuronal receptor cell adhesion recognition sequence
ESIDADTK

SEQ ID NO: 3701 - protein, 9 aa, Artificial Sequence
  Representative cyclic modulating agent based on cadherin-related neuronal receptor cell adhesion recognition sequence
ESIDADTGK

SEQ ID NO: 3702 - protein, 8 aa, Artificial Sequence
  Representative cyclic modulating agent based on cadherin-related neuronal receptor cell adhesion recognition sequence
EFSIDADK

SEQ ID NO: 3703 - protein, 9 aa, Artificial Sequence
  Representative cyclic modulating agent based on cadherin-related neuronal receptor cell adhesion recognition sequence
EFSIDADTK

SEQ ID NO: 3704 - protein, 10 aa, Artificial Sequence
  Representative cyclic modulating agent based on cadherin-related neuronal receptor cell adhesion recognition sequence
EFSIDADTGK

SEQ ID NO: 3705 - protein, 9 aa, Artificial Sequence
  Representative cyclic modulating agent based on cadherin-related neuronal receptor cell adhesion recognition sequence
EQFSIDADK

SEQ ID NO: 3706 - protein, 10 aa, Artificial Sequence
  Representative cyclic modulating agent based on cadherin-related neuronal receptor cell adhesion recognition sequence
EQFSIDADTK

SEQ ID NO: 3707 - protein, 11 aa, Artificial Sequence
  Representative cyclic modulating agent based on cadherin-related neuronal receptor cell adhesion recognition sequence
EQFSIDADTGK

SEQ ID NO: 3708 - protein, 5 aa, Artificial Sequence
  Representative cyclic modulating agent based on cadherin-related neuronal receptor cell adhesion recognition sequence
EDSVK

SEQ ID NO: 3709 - protein, 6 aa, Artificial Sequence
  Representative cyclic modulating agent based on cadherin-related neuronal receptor cell adhesion recognition sequence
EDSVSK

SEQ ID NO: 3710 - protein, 7 aa, Artificial Sequence
  Representative cyclic modulating agent based on cadherin-related neuronal receptor cell adhesion recognition sequence
EDSVSGK

SEQ ID NO: 3711 - protein, 6 aa, Artificial Sequence
  Representative cyclic modulating agent based on cadherin-related neuronal receptor cell adhesion recognition sequence
EIDSVK

SEQ ID NO: 3712 - protein, 7 aa, Artificial Sequence
  Representative cyclic modulating agent based on cadherin-related neuronal receptor cell adhesion recognition sequence
EIDSVSK

SEQ ID NO: 3713 - protein, 8 aa, Artificial Sequence
  Representative cyclic modulating agent based on cadherin-related neuronal receptor cell adhesion recognition sequence
EIDSVSGK

SEQ ID NO: 3714 - protein, 7 aa, Artificial Sequence
  Representative cyclic modulating agent based on cadherin-related neuronal receptor cell adhesion recognition sequence
EHIDSVK

SEQ ID NO: 3715 - protein, 8 aa, Artificial Sequence
  Representative cyclic modulating agent based on cadherin-related neuronal receptor cell adhesion recognition sequence
EHIDSVSK

SEQ ID NO: 3716 - protein, 9 aa, Artificial Sequence
  Representative cyclic modulating agent based on cadherin-related neuronal receptor cell adhesion recognition sequence
EHIDSVSGK

SEQ ID NO: 3717 - protein, 8 aa, Artificial Sequence
  Representative cyclic modulating agent based on cadherin-related neuronal receptor cell adhesion recognition sequence
EFHIDSVK

SEQ ID NO: 3718 - protein, 9 aa, Artificial Sequence
  Representative cyclic modulating agent based on cadherin-related neuronal receptor cell adhesion recognition sequence
EFHIDSVSK

SEQ ID NO: 3719 - protein, 10 aa, Artificial Sequence
  Representative cyclic modulating agent based on cadherin-related neuronal receptor cell adhesion recognition sequence
EFHIDSVSGK

SEQ ID NO: 3720 - protein, 9 aa, Artificial Sequence
  Representative cyclic modulating agent based on cadherin-related neuronal receptor cell adhesion recognition sequence
ETFHIDSVK

SEQ ID NO: 3721 - protein, 10 aa, Artificial Sequence
  Representative cyclic modulating agent based on cadherin-related neuronal receptor cell adhesion recognition sequence
ETFHIDSVSK

SEQ ID NO: 3722 - protein, 11 aa, Artificial Sequence
  Representative cyclic modulating agent based on cadherin-related neuronal receptor cell adhesion recognition sequence
ETFHIDSVSGK

SEQ ID NO: 3723 - protein, 5 aa, Artificial Sequence
  Representative cyclic modulating agent based on cadherin-related neuronal receptor cell adhesion recognition sequence
EDSNK

SEQ ID NO: 3724 - protein, 6 aa, Artificial Sequence
  Representative cyclic modulating agent based on cadherin-related neuronal receptor cell adhesion recognition sequence
EDSNSK

SEQ ID NO: 3725 - protein, 7 aa, Artificial Sequence
  Representative cyclic modulating agent based on cadherin-related neuronal receptor cell adhesion recognition sequence
EDSNSGK

SEQ ID NO: 3726 - protein, 6 aa, Artificial Sequence
  Representative cyclic modulating agent based on cadherin-related neuronal receptor cell adhesion recognition sequence
EIDSNK

SEQ ID NO: 3727 - protein, 7 aa, Artificial Sequence
  Representative cyclic modulating agent based on cadherin-related neuronal receptor cell adhesion recognition sequence
EIDSNSK

SEQ ID NO: 3728 - protein, 8 aa, Artificial Sequence
  Representative cyclic modulating agent based on cadherin-related neuronal receptor cell adhesion recognition sequence
EIDSNSGK

SEQ ID NO: 3729 - protein, 7 aa, Artificial Sequence
  Representative cyclic modulating agent based on cadherin-related neuronal receptor cell adhesion recognition sequence
ENIDSNK

SEQ ID NO: 3730 - protein, 8 aa, Artificial Sequence
  Representative cyclic modulating agent based on cadherin-related neuronal receptor cell adhesion recognition sequence
ENIDSNSK

SEQ ID NO: 3731 - protein, 9 aa, Artificial Sequence
  Representative cyclic modulating agent based on cadherin-related neuronal receptor cell adhesion recognition sequence
ENIDSNSGK

SEQ ID NO: 3732 - protein, 8 aa, Artificial Sequence
  Representative cyclic modulating agent based on cadherin-related neuronal receptor cell adhesion recognition sequence
EFNIDSNK

SEQ ID NO: 3733 - protein, 9 aa, Artificial Sequence
  Representative cyclic modulating agent based on cadherin-related neuronal receptor cell adhesion recognition sequence
EFNIDSNSK

SEQ ID NO: 3734 - protein, 10 aa, Artificial Sequence
  Representative cyclic modulating agent based on cadherin-related neuronal receptor cell adhesion recognition sequence
EFNIDSNSGK

SEQ ID NO: 3735 - protein, 9 aa, Artificial Sequence
  Representative cyclic modulating agent based on cadherin-related neuronal receptor cell adhesion recognition sequence
EAFNIDSNK

SEQ ID NO: 3736 - protein, 8 aa, Artificial Sequence
  Representative cyclic modulating agent based on cadherin-related neuronal receptor cell adhesion recognition sequence
EIINENTK

SEQ ID NO: 3737 - protein, 10 aa, Artificial Sequence
  Representative cyclic modulating agent based on cadherin-related neuronal receptor cell adhesion recognition sequence
EAFNIDSNSK

SEQ ID NO: 3738 - protein, 11 aa, Artificial Sequence
  Representative cyclic modulating agent based on cadherin-related neuronal receptor cell adhesion recognition sequence
EAFNIDSNSGK

SEQ ID NO: 3739 - protein, 5 aa, Artificial Sequence
  Representative cyclic modulating agent based on cadherin-related neuronal receptor cell adhesion recognition sequence
EDSSK

SEQ ID NO: 3740 - protein, 6 aa, Artificial Sequence
  Representative cyclic modulating agent based on cadherin-related neuronal receptor cell adhesion recognition sequence
EDSSSK

SEQ ID NO: 3741 - protein, 7 aa, Artificial Sequence
  Representative cyclic modulating agent based on cadherin-related neuronal receptor cell adhesion recognition sequence
EDSSSGK

SEQ ID NO: 3742 - protein, 6 aa, Artificial Sequence
  Representative cyclic modulating agent based on cadherin-related neuronal receptor cell adhesion recognition sequence
EIDSSK

SEQ ID NO: 3743 - protein, 7 aa, Artificial Sequence
  Representative cyclic modulating agent based on cadherin-related neuronal receptor cell adhesion recognition sequence
EIDSSSK

SEQ ID NO: 3744 - protein, 8 aa, Artificial Sequence
  Representative cyclic modulating agent based on cadherin-related neuronal receptor cell adhesion recognition sequence
EIDSSSGK

SEQ ID NO: 3745 - protein, 7 aa, Artificial Sequence
  Representative cyclic modulating agent based on cadherin-related neuronal receptor cell adhesion recognition sequence
ETIDSSK

SEQ ID NO: 3746 - protein, 8 aa, Artificial Sequence
  Representative cyclic modulating agent based on cadherin-related neuronal receptor cell adhesion recognition sequence
ETIDSSSK

SEQ ID NO: 3747 - protein, 9 aa, Artificial Sequence
  Representative cyclic modulating agent based on cadherin-related neuronal receptor cell adhesion recognition sequence
ETIDSSSGK

SEQ ID NO: 3748 - protein, 8 aa, Artificial Sequence
  Representative cyclic modulating agent based on cadherin-related neuronal receptor cell adhesion recognition sequence
EFTIDSSK

SEQ ID NO: 3749 - protein, 9 aa, Artificial Sequence
  Representative cyclic modulating agent based on cadherin-related neuronal receptor cell adhesion recognition sequence
EFTIDSSSK

SEQ ID NO: 3750 - protein, 10 aa, Artificial Sequence
  Representative cyclic modulating agent based on cadherin-related neuronal receptor cell adhesion recognition sequence
EFTIDSSSGK

SEQ ID NO: 3751 - protein, 9 aa, Artificial Sequence
  Representative cyclic modulating agent based on cadherin-related neuronal receptor cell adhesion recognition sequence
EKFTIDSSK

SEQ ID NO: 3752 - protein, 10 aa, Artificial Sequence
  Representative cyclic modulating agent based on cadherin-related neuronal receptor cell adhesion recognition sequence
EKFTIDSSSK

SEQ ID NO: 3753 - protein, 11 aa, Artificial Sequence
  Representative cyclic modulating agent based on cadherin-related neuronal receptor cell adhesion recognition sequence
EKFTIDSSSGK

SEQ ID NO: 3754 - protein, 5 aa, Artificial Sequence
  Representative cyclic modulating agent based on cadherin-related neuronal receptor cell adhesion recognition sequence
EDEKK

SEQ ID NO: 3755 - protein, 6 aa, Artificial Sequence
  Representative cyclic modulating agent based on cadherin-related neuronal receptor cell adhesion recognition sequence
EDEKNK

SEQ ID NO: 3756 - protein, 7 aa, Artificial Sequence
  Representative cyclic modulating agent based on cadherin-related neuronal receptor cell adhesion recognition sequence
EDEKNGK

SEQ ID NO: 3757 - protein, 6 aa, Artificial Sequence
  Representative cyclic modulating agent based on cadherin-related neuronal receptor cell adhesion recognition sequence
ELDEKK

SEQ ID NO: 3758 - protein, 7 aa, Artificial Sequence
  Representative cyclic modulating agent based on cadherin-related neuronal receptor cell adhesion recognition sequence
ELDEKNK

SEQ ID NO: 3759 - protein, 8 aa, Artificial Sequence
  Representative cyclic modulating agent based on cadherin-related neuronal receptor cell adhesion recognition sequence
ELDEKNGK

SEQ ID NO: 3760 - protein, 7 aa, Artificial Sequence
  Representative cyclic modulating agent based on cadherin-related neuronal receptor cell adhesion recognition sequence
ETLDEKK

SEQ ID NO: 3761 - protein, 8 aa, Artificial Sequence
  Representative cyclic modulating agent based on cadherin-related neuronal receptor cell adhesion recognition sequence
ETLDEKNK

SEQ ID NO: 3762 - protein, 9 aa, Artificial Sequence
  Representative cyclic modulating agent based on cadherin-related neuronal receptor cell adhesion recognition sequence
ETLDEKNGK

SEQ ID NO: 3763 - protein, 8 aa, Artificial Sequence
  Representative cyclic modulating agent based on cadherin-related neuronal receptor cell adhesion recognition sequence
EFTLDEKK

SEQ ID NO: 3764 - protein, 9 aa, Artificial Sequence
  Representative cyclic modulating agent based on cadherin-related neuronal receptor cell adhesion recognition sequence
EFTLDEKNK

SEQ ID NO: 3765 - protein, 10 aa, Artificial Sequence
  Representative cyclic modulating agent based on cadherin-related neuronal receptor cell adhesion recognition sequence
EFTLDEKNGK

SEQ ID NO: 3766 - protein, 9 aa, Artificial Sequence
  Representative cyclic modulating agent based on cadherin-related neuronal receptor cell adhesion recognition sequence
ELFTLDEKK

SEQ ID NO: 3767 - protein, 10 aa, Artificial Sequence
  Representative cyclic modulating agent based on cadherin-related neuronal receptor cell adhesion recognition sequence
ELFTLDEKNK

SEQ ID NO: 3768 - protein, 11 aa, Artificial Sequence
  Representative cyclic modulating agent based on cadherin-related neuronal receptor cell adhesion recognition sequence
ELFTLDEKNGK

SEQ ID NO: 3769 - protein, 5 aa, Artificial Sequence
  Representative cyclic modulating agent based on cadherin-related neuronal receptor cell adhesion recognition sequence
ENEKK

SEQ ID NO: 3770 - protein, 6 aa, Artificial Sequence
  Representative cyclic modulating agent based on cadherin-related neuronal receptor cell adhesion recognition sequence
ENEKTK

SEQ ID NO: 3771 - protein, 7 aa, Artificial Sequence
  Representative cyclic modulating agent based on cadherin-related neuronal receptor cell adhesion recognition sequence
ENEKTGK

SEQ ID NO: 3772 - protein, 6 aa, Artificial Sequence
  Representative cyclic modulating agent based on cadherin-related neuronal receptor cell adhesion recognition sequence
EINEKK

SEQ ID NO: 3773 - protein, 7 aa, Artificial Sequence
  Representative cyclic modulating agent based on cadherin-related neuronal receptor cell adhesion recognition sequence
EINEKTK

SEQ ID NO: 3774 - protein, 8 aa, Artificial Sequence
  Representative cyclic modulating agent based on cadherin-related neuronal receptor cell adhesion recognition sequence
EINEKTGK

SEQ ID NO: 3775 - protein, 7 aa, Artificial Sequence
  Representative cyclic modulating agent based on cadherin-related neuronal receptor cell adhesion recognition sequence
ELINEKK

SEQ ID NO: 3776 - protein, 8 aa, Artificial Sequence
  Representative cyclic modulating agent based on cadherin-related neuronal receptor cell adhesion recognition sequence
ELINEKTK

SEQ ID NO: 3777 - protein, 9 aa, Artificial Sequence
  Representative cyclic modulating agent based on cadherin-related neuronal receptor cell adhesion recognition sequence
ELINEKTGK

SEQ ID NO: 3778 - protein, 8 aa, Artificial Sequence
  Representative cyclic modulating agent based on cadherin-related neuronal receptor cell adhesion recognition sequence
EFLINEKK

SEQ ID NO: 3779 - protein, 9 aa, Artificial Sequence
  Representative cyclic modulating agent based on cadherin-related neuronal receptor cell adhesion recognition sequence
EFLINEKTK

SEQ ID NO: 3780 - protein, 10 aa, Artificial Sequence
  Representative cyclic modulating agent based on cadherin-related neuronal receptor cell adhesion recognition sequence
EFLINEKTGK

SEQ ID NO: 3781 - protein, 9 aa, Artificial Sequence
  Representative cyclic modulating agent based on cadherin-related neuronal receptor cell adhesion recognition sequence
EKFLINEKK

SEQ ID NO: 3782 - protein, 10 aa, Artificial Sequence
  Representative cyclic modulating agent based on cadherin-related neuronal receptor cell adhesion recognition sequence
EKFLINEKTK

SEQ ID NO: 3783 - protein, 11 aa, Artificial Sequence
  Representative cyclic modulating agent based on cadherin-related neuronal receptor cell adhesion recognition sequence
EKFLINEKTGK

SEQ ID NO: 3784 - protein, 5 aa, Artificial Sequence
  Representative cyclic modulating agent based on cadherin-related neuronal receptor cell adhesion recognition sequence
KDPVD

SEQ ID NO: 3785 - protein, 6 aa, Artificial Sequence
  Representative cyclic modulating agent based on cadherin-related neuronal receptor cell adhesion recognition sequence
KDPVSD

SEQ ID NO: 3786 - protein, 7 aa, Artificial Sequence
  Representative cyclic modulating agent based on cadherin-related neuronal receptor cell adhesion recognition sequence
KDPVSGD

SEQ ID NO: 3787 - protein, 6 aa, Artificial Sequence
  Representative cyclic modulating agent based on cadherin-related neuronal receptor cell adhesion recognition sequence
KIDPVD

SEQ ID NO: 3788 - protein, 7 aa, Artificial Sequence
  Representative cyclic modulating agent based on cadherin-related neuronal receptor cell adhesion recognition sequence
KIDPVSD

SEQ ID NO: 3789 - protein, 8 aa, Artificial Sequence
  Representative cyclic modulating agent based on cadherin-related neuronal receptor cell adhesion recognition sequence
KIDPVSGD

SEQ ID NO: 3790 - protein, 7 aa, Artificial Sequence
  Representative cyclic modulating agent based on cadherin-related neuronal receptor cell adhesion recognition sequence
KHIDPVD

SEQ ID NO: 3791 - protein, 8 aa, Artificial Sequence
  Representative cyclic modulating agent based on cadherin-related neuronal receptor cell adhesion recognition sequence
KHIDPVSD

SEQ ID NO: 3792 - protein, 9 aa, Artificial Sequence
  Representative cyclic modulating agent based on cadherin-related neuronal receptor cell adhesion recognition sequence
KHIDPVSGD

SEQ ID NO: 3793 - protein, 8 aa, Artificial Sequence
  Representative cyclic modulating agent based on cadherin-related neuronal receptor cell adhesion recognition sequence
KFHIDPVD

SEQ ID NO: 3794 - protein, 9 aa, Artificial Sequence
  Representative cyclic modulating agent based on cadherin-related neuronal receptor cell adhesion recognition sequence
KFHIDPVSD

SEQ ID NO: 3795 - protein, 10 aa, Artificial Sequence
  Representative cyclic modulating agent based on cadherin-related neuronal receptor cell adhesion recognition sequence
KFHIDPVSGD

SEQ ID NO: 3796 - protein, 9 aa, Artificial Sequence
  Representative cyclic modulating agent based on cadherin-related neuronal receptor cell adhesion recognition sequence
KKFHIDPVD

SEQ ID NO: 3797 - protein, 10 aa, Artificial Sequence
  Representative cyclic modulating agent based on cadherin-related neuronal receptor cell adhesion recognition sequence
KKFHIDPVSD

SEQ ID NO: 3798 - protein, 11 aa, Artificial Sequence
  Representative cyclic modulating agent based on cadherin-related neuronal receptor cell adhesion recognition sequence
KKFHIDPVSGD

SEQ ID NO: 3799 - protein, 5 aa, Artificial Sequence
  Representative cyclic modulating agent based on cadherin-related neuronal receptor cell adhesion recognition sequence
KDADD

SEQ ID NO: 3800 - protein, 6 aa, Artificial Sequence
  Representative cyclic modulating agent based on cadherin-related neuronal receptor cell adhesion recognition sequence
KDADTD

SEQ ID NO: 3801 - protein, 7 aa, Artificial Sequence
  Representative cyclic modulating agent based on cadherin-related neuronal receptor cell adhesion recognition sequence
KDADTGD

SEQ ID NO: 3802 - protein, 6 aa, Artificial Sequence
  Representative cyclic modulating agent based on cadherin-related neuronal receptor cell adhesion recognition sequence
KIDADD

SEQ ID NO: 3803 - protein, 7 aa, Artificial Sequence
  Representative cyclic modulating agent based on cadherin-related neuronal receptor cell adhesion recognition sequence
KIDADTD

SEQ ID NO: 3804 - protein, 8 aa, Artificial Sequence
  Representative cyclic modulating agent based on cadherin-related neuronal receptor cell adhesion recognition sequence
KIDADTGD

SEQ ID NO: 3805 - protein, 7 aa, Artificial Sequence
  Representative cyclic modulating agent based on cadherin-related neuronal receptor cell adhesion recognition sequence
KSIDADD

SEQ ID NO: 3806 - protein, 8 aa, Artificial Sequence
  Representative cyclic modulating agent based on cadherin-related neuronal receptor cell adhesion recognition sequence
KSIDADTD

SEQ ID NO: 3807 - protein, 9 aa, Artificial Sequence
  Representative cyclic modulating agent based on cadherin-related neuronal receptor cell adhesion recognition sequence
KSIDADTGD

SEQ ID NO: 3808 - protein, 8 aa, Artificial Sequence
  Representative cyclic modulating agent based on cadherin-related neuronal receptor cell adhesion recognition sequence
KFSIDADD

SEQ ID NO: 3809 - protein, 9 aa, Artificial Sequence
  Representative cyclic modulating agent based on cadherin-related neuronal receptor cell adhesion recognition sequence
KFSIDADTD

SEQ ID NO: 3810 - protein, 10 aa, Artificial Sequence
  Representative cyclic modulating agent based on cadherin-related neuronal receptor cell adhesion recognition sequence
KFSIDADTGD

SEQ ID NO: 3811 - protein, 9 aa, Artificial Sequence
  Representative cyclic modulating agent based on cadherin-related neuronal receptor cell adhesion recognition sequence
KQFSIDADD

SEQ ID NO: 3812 - protein, 10 aa, Artificial Sequence
  Representative cyclic modulating agent based on cadherin-related neuronal receptor cell adhesion recognition sequence
KQFSIDADTD

SEQ ID NO: 3813 - protein, 11 aa, Artificial Sequence
  Representative cyclic modulating agent based on cadherin-related neuronal receptor cell adhesion recognition sequence
KQFSIDADTGD

SEQ ID NO: 3814 - protein, 5 aa, Artificial Sequence
  Representative cyclic modulating agent based on cadherin-related neuronal receptor cell adhesion recognition sequence
KDSVD

SEQ ID NO: 3815 - protein, 6 aa, Artificial Sequence
  Representative cyclic modulating agent based on cadherin-related neuronal receptor cell adhesion recognition sequence
KDSVSD

SEQ ID NO: 3816 - protein, 7 aa, Artificial Sequence
  Representative cyclic modulating agent based on cadherin-related neuronal receptor cell adhesion recognition sequence
KDSVSGD

SEQ ID NO: 3817 - protein, 6 aa, Artificial Sequence
  Representative cyclic modulating agent based on cadherin-related neuronal receptor cell adhesion recognition sequence
KIDSVD

SEQ ID NO: 3818 - protein, 7 aa, Artificial Sequence
  Representative cyclic modulating agent based on cadherin-related neuronal receptor cell adhesion recognition sequence
KIDSVSD

SEQ ID NO: 3819 - protein, 8 aa, Artificial Sequence
  Representative cyclic modulating agent based on cadherin-related neuronal receptor cell adhesion recognition sequence
KIDSVSGD

SEQ ID NO: 3820 - protein, 7 aa, Artificial Sequence
  Representative cyclic modulating agent based on cadherin-related neuronal receptor cell adhesion recognition sequence
KHIDSVD

SEQ ID NO: 3821 - protein, 8 aa, Artificial Sequence
  Representative cyclic modulating agent based on cadherin-related neuronal receptor cell adhesion recognition sequence
KHIDSVSD

SEQ ID NO: 3822 - protein, 9 aa, Artificial Sequence
  Representative cyclic modulating agent based on cadherin-related neuronal receptor cell adhesion recognition sequence
KHIDSVSGD

SEQ ID NO: 3823 - protein, 8 aa, Artificial Sequence
  Representative cyclic modulating agent based on cadherin-related neuronal receptor cell adhesion recognition sequence
KFHIDSVD

SEQ ID NO: 3824 - protein, 9 aa, Artificial Sequence
  Representative cyclic modulating agent based on cadherin-related neuronal receptor cell adhesion recognition sequence
KFHIDSVSD

SEQ ID NO: 3825 - protein, 10 aa, Artificial Sequence
  Representative cyclic modulating agent based on cadherin-related neuronal receptor cell adhesion recognition sequence
KFHIDSVSGD

SEQ ID NO: 3826 - protein, 9 aa, Artificial Sequence
  Representative cyclic modulating agent based on cadherin-related neuronal receptor cell adhesion recognition sequence
KTFHIDSVD

SEQ ID NO: 3827 - protein, 10 aa, Artificial Sequence
  Representative cyclic modulating agent based on cadherin-related neuronal receptor cell adhesion recognition sequence
KTFHIDSVSD

SEQ ID NO: 3828 - protein, 11 aa, Artificial Sequence
  Representative cyclic modulating agent based on cadherin-related neuronal receptor cell adhesion recognition sequence
KTFHIDSVSGD

SEQ ID NO: 3829 - protein, 5 aa, Artificial Sequence
  Representative cyclic modulating agent based on cadherin-related neuronal receptor cell adhesion recognition sequence
KDSND

SEQ ID NO: 3830 - protein, 6 aa, Artificial Sequence
  Representative cyclic modulating agent based on cadherin-related neuronal receptor cell adhesion recognition sequence
KDSNSD

SEQ ID NO: 3831 - protein, 7 aa, Artificial Sequence
  Representative cyclic modulating agent based on cadherin-related neuronal receptor cell adhesion recognition sequence
KDSNSGD

SEQ ID NO: 3832 - protein, 6 aa, Artificial Sequence
  Representative cyclic modulating agent based on cadherin-related neuronal receptor cell adhesion recognition sequence
KIDSND

SEQ ID NO: 3833 - protein, 7 aa, Artificial Sequence
  Representative cyclic modulating agent based on cadherin-related neuronal receptor cell adhesion recognition sequence
KIDSNSD

SEQ ID NO: 3834 - protein, 8 aa, Artificial Sequence
  Representative cyclic modulating agent based on cadherin-related neuronal receptor cell adhesion recognition sequence
KIDSNSGD

SEQ ID NO: 3835 - protein, 7 aa, Artificial Sequence
  Representative cyclic modulating agent based on cadherin-related neuronal receptor cell adhesion recognition sequence
KNIDSND

SEQ ID NO: 3836 - protein, 8 aa, Artificial Sequence
  Representative cyclic modulating agent based on cadherin-related neuronal receptor cell adhesion recognition sequence
KNIDSNSD

SEQ ID NO: 3837 - protein, 9 aa, Artificial Sequence
  Representative cyclic modulating agent based on cadherin-related neuronal receptor cell adhesion recognition sequence
KNIDSNSGD

SEQ ID NO: 3838 - protein, 8 aa, Artificial Sequence
  Representative cyclic modulating agent based on cadherin-related neuronal receptor cell adhesion recognition sequence
KFNIDSND

SEQ ID NO: 3839 - protein, 9 aa, Artificial Sequence
  Representative cyclic modulating agent based on cadherin-related neuronal receptor cell adhesion recognition sequence
KFNIDSNSD

SEQ ID NO: 3840 - protein, 10 aa, Artificial Sequence
  Representative cyclic modulating agent based on cadherin-related neuronal receptor cell adhesion recognition sequence
KFNIDSNSGD

SEQ ID NO: 3841 - protein, 9 aa, Artificial Sequence
  Representative cyclic modulating agent based on cadherin-related neuronal receptor cell adhesion recognition sequence
KAFNIDSND

SEQ ID NO: 3842 - protein, 9 aa, Artificial Sequence
  Representative cyclic modulating agent based on cadherin-related neuronal receptor cell adhesion recognition sequence
EFIINENTK

SEQ ID NO: 3843 - protein, 10 aa, Artificial Sequence
  Representative cyclic modulating agent based on cadherin-related neuronal receptor cell adhesion recognition sequence
KAFNIDSNSD

SEQ ID NO: 3844 - protein, 11 aa, Artificial Sequence
  Representative cyclic modulating agent based on cadherin-related neuronal receptor cell adhesion recognition sequence
KAFNIDSNSGD

SEQ ID NO: 3845 - protein, 5 aa, Artificial Sequence
  Representative cyclic modulating agent based on cadherin-related neuronal receptor cell adhesion recognition sequence
KDSSD

SEQ ID NO: 3846 - protein, 6 aa, Artificial Sequence
  Representative cyclic modulating agent based on cadherin-related neuronal receptor cell adhesion recognition sequence
KDSSSD

SEQ ID NO: 3847 - protein, 7 aa, Artificial Sequence
  Representative cyclic modulating agent based on cadherin-related neuronal receptor cell adhesion recognition sequence
KDSSSGD

SEQ ID NO: 3848 - protein, 6 aa, Artificial Sequence
  Representative cyclic modulating agent based on cadherin-related neuronal receptor cell adhesion recognition sequence
KIDSSD

SEQ ID NO: 3849 - protein, 7 aa, Artificial Sequence
  Representative cyclic modulating agent based on cadherin-related neuronal receptor cell adhesion recognition sequence
KIDSSSD

SEQ ID NO: 3850 - protein, 8 aa, Artificial Sequence
  Representative cyclic modulating agent based on cadherin-related neuronal receptor cell adhesion recognition sequence
KIDSSSGD

SEQ ID NO: 3851 - protein, 7 aa, Artificial Sequence
  Representative cyclic modulating agent based on cadherin-related neuronal receptor cell adhesion recognition sequence
KTIDSSD

SEQ ID NO: 3852 - protein, 8 aa, Artificial Sequence
  Representative cyclic modulating agent based on cadherin-related neuronal receptor cell adhesion recognition sequence
KTIDSSSD

SEQ ID NO: 3853 - protein, 9 aa, Artificial Sequence
  Representative cyclic modulating agent based on cadherin-related neuronal receptor cell adhesion recognition sequence
KTIDSSSGD

SEQ ID NO: 3854 - protein, 8 aa, Artificial Sequence
  Representative cyclic modulating agent based on cadherin-related neuronal receptor cell adhesion recognition sequence
KFTIDSSD

SEQ ID NO: 3855 - protein, 9 aa, Artificial Sequence
  Representative cyclic modulating agent based on cadherin-related neuronal receptor cell adhesion recognition sequence
KFTIDSSSD

SEQ ID NO: 3856 - protein, 10 aa, Artificial Sequence
  Representative cyclic modulating agent based on cadherin-related neuronal receptor cell adhesion recognition sequence
KFTIDSSSGD

SEQ ID NO: 3857 - protein, 9 aa, Artificial Sequence
  Representative cyclic modulating agent based on cadherin-related neuronal receptor cell adhesion recognition sequence
KKFTIDSSD

SEQ ID NO: 3858 - protein, 10 aa, Artificial Sequence
  Representative cyclic modulating agent based on cadherin-related neuronal receptor cell adhesion recognition sequence
KKFTIDSSSD

SEQ ID NO: 3859 - protein, 11 aa, Artificial Sequence
  Representative cyclic modulating agent based on cadherin-related neuronal receptor cell adhesion recognition sequence
KKFTIDSSSGD

SEQ ID NO: 3860 - protein, 5 aa, Artificial Sequence
  Representative cyclic modulating agent based on cadherin-related neuronal receptor cell adhesion recognition sequence
KDEKD

SEQ ID NO: 3861 - protein, 6 aa, Artificial Sequence
  Representative cyclic modulating agent based on cadherin-related neuronal receptor cell adhesion recognition sequence
KDEKND

SEQ ID NO: 3862 - protein, 7 aa, Artificial Sequence
  Representative cyclic modulating agent based on cadherin-related neuronal receptor cell adhesion recognition sequence
KDEKNGD

SEQ ID NO: 3863 - protein, 6 aa, Artificial Sequence
  Representative cyclic modulating agent based on cadherin-related neuronal receptor cell adhesion recognition sequence
KLDEKD

SEQ ID NO: 3864 - protein, 7 aa, Artificial Sequence
  Representative cyclic modulating agent based on cadherin-related neuronal receptor cell adhesion recognition sequence
KLDEKND

SEQ ID NO: 3865 - protein, 8 aa, Artificial Sequence
  Representative cyclic modulating agent based on cadherin-related neuronal receptor cell adhesion recognition sequence
KLDEKNGD

SEQ ID NO: 3866 - protein, 7 aa, Artificial Sequence
  Representative cyclic modulating agent based on cadherin-related neuronal receptor cell adhesion recognition sequence
KTLDEKD

SEQ ID NO: 3867 - protein, 8 aa, Artificial Sequence
  Representative cyclic modulating agent based on cadherin-related neuronal receptor cell adhesion recognition sequence
KTLDEKND

SEQ ID NO: 3868 - protein, 9 aa, Artificial Sequence
  Representative cyclic modulating agent based on cadherin-related neuronal receptor cell adhesion recognition sequence
KTLDEKNGD

SEQ ID NO: 3869 - protein, 8 aa, Artificial Sequence
  Representative cyclic modulating agent based on cadherin-related neuronal receptor cell adhesion recognition sequence
KFTLDEKD

SEQ ID NO: 3870 - protein, 9 aa, Artificial Sequence
  Representative cyclic modulating agent based on cadherin-related neuronal receptor cell adhesion recognition sequence
KFTLDEKND

SEQ ID NO: 3871 - protein, 10 aa, Artificial Sequence
  Representative cyclic modulating agent based on cadherin-related neuronal receptor cell adhesion recognition sequence
KFTLDEKNGD

SEQ ID NO: 3872 - protein, 9 aa, Artificial Sequence
  Representative cyclic modulating agent based on cadherin-related neuronal receptor cell adhesion recognition sequence
KLFTLDEKD

SEQ ID NO: 3873 - protein, 10 aa, Artificial Sequence
  Representative cyclic modulating agent based on cadherin-related neuronal receptor cell adhesion recognition sequence
KLFTLDEKND

SEQ ID NO: 3874 - protein, 11 aa, Artificial Sequence
  Representative cyclic modulating agent based on cadherin-related neuronal receptor cell adhesion recognition sequence
KLFTLDEKNGD

SEQ ID NO: 3875 - protein, 5 aa, Artificial Sequence
  Representative cyclic modulating agent based on cadherin-related neuronal receptor cell adhesion recognition sequence
KNEKD

SEQ ID NO: 3876 - protein, 6 aa, Artificial Sequence
  Representative cyclic modulating agent based on cadherin-related neuronal receptor cell adhesion recognition sequence
KNEKTD

SEQ ID NO: 3877 - protein, 7 aa, Artificial Sequence
  Representative cyclic modulating agent based on cadherin-related neuronal receptor cell adhesion recognition sequence
KNEKTGD

SEQ ID NO: 3878 - protein, 6 aa, Artificial Sequence
  Representative cyclic modulating agent based on cadherin-related neuronal receptor cell adhesion recognition sequence
KINEKD

SEQ ID NO: 3879 - protein, 7 aa, Artificial Sequence
  Representative cyclic modulating agent based on cadherin-related neuronal receptor cell adhesion recognition sequence
KINEKTD

SEQ ID NO: 3880 - protein, 8 aa, Artificial Sequence
  Representative cyclic modulating agent based on cadherin-related neuronal receptor cell adhesion recognition sequence
KINEKTGD

SEQ ID NO: 3881 - protein, 7 aa, Artificial Sequence
  Representative cyclic modulating agent based on cadherin-related neuronal receptor cell adhesion recognition sequence
KLINEKD

SEQ ID NO: 3882 - protein, 8 aa, Artificial Sequence
  Representative cyclic modulating agent based on cadherin-related neuronal receptor cell adhesion recognition sequence
KLINEKTD

SEQ ID NO: 3883 - protein, 9 aa, Artificial Sequence
  Representative cyclic modulating agent based on cadherin-related neuronal receptor cell adhesion recognition sequence
KLINEKTGD

SEQ ID NO: 3884 - protein, 8 aa, Artificial Sequence
  Representative cyclic modulating agent based on cadherin-related neuronal receptor cell adhesion recognition sequence
KFLINEKD

SEQ ID NO: 3885 - protein, 9 aa, Artificial Sequence
  Representative cyclic modulating agent based on cadherin-related neuronal receptor cell adhesion recognition sequence
KFLINEKTD

SEQ ID NO: 3886 - protein, 10 aa, Artificial Sequence
  Representative cyclic modulating agent based on cadherin-related neuronal receptor cell adhesion recognition sequence
KFLINEKTGD

SEQ ID NO: 3887 - protein, 9 aa, Artificial Sequence
  Representative cyclic modulating agent based on cadherin-related neuronal receptor cell adhesion recognition sequence
KKFLINEKD

SEQ ID NO: 3888 - protein, 10 aa, Artificial Sequence
  Representative cyclic modulating agent based on cadherin-related neuronal receptor cell adhesion recognition sequence
KKFLINEKTD

SEQ ID NO: 3889 - protein, 11 aa, Artificial Sequence
  Representative cyclic modulating agent based on cadherin-related neuronal receptor cell adhesion recognition sequence
KKFLINEKTGD

SEQ ID NO: 3890 - protein, 10 aa, Artificial Sequence
  Representative cyclic modulating agent based on cadherin-6 cell adhesion recognition sequence
ELFIINENTK

SEQ ID NO: 3891 - protein, 7 aa, Artificial Sequence
  Representative cyclic modulating agent based on cadherin-6 cell adhesion recognition sequence
ENENTGK

SEQ ID NO: 3892 - protein, 8 aa, Artificial Sequence
  Representative cyclic modulating agent based on cadherin-6 cell adhesion recognition sequence
EINENTGK

SEQ ID NO: 3893 - protein, 9 aa, Artificial Sequence
  Representative cyclic modulating agent based on cadherin-6 cell adhesion recognition sequence
EIINENTGK

SEQ ID NO: 3894 - protein, 10 aa, Artificial Sequence
  Representative cyclic modulating agent based on cadherin-6 cell adhesion recognition sequence
EFIINENTGK

SEQ ID NO: 3895 - protein, 11 aa, Artificial Sequence
  Representative cyclic modulating agent based on cadherin-6 cell adhesion recognition sequence
ELFIINENTGK

SEQ ID NO: 3896 - protein, 8 aa, Artificial Sequence
  Representative cyclic modulating agent based on cadherin-7 cell adhesion recognition sequence
DIIDENTK

SEQ ID NO: 3897 - protein, 9 aa, Artificial Sequence
  Representative cyclic modulating agent based on cadherin-7 cell adhesion recognition sequence
DFIIDENTK

SEQ ID NO: 3898 - protein, 10 aa, Artificial Sequence
  Representative cyclic modulating agent based on cadherin-7 cell adhesion recognition sequence
DIFIIDENTK

SEQ ID NO: 3899 - protein, 7 aa, Artificial Sequence
  Representative cyclic modulating agent based on cadherin-7 cell adhesion recognition sequence
DDENTGK

SEQ ID NO: 3900 - protein, 8 aa, Artificial Sequence
  Representative cyclic modulating agent based on cadherin-7 cell adhesion recognition sequence
DIDENTGK

SEQ ID NO: 3901 - protein, 9 aa, Artificial Sequence
  Representative cyclic modulating agent based on cadherin-7 cell adhesion recognition sequence
DIIDENTGK

SEQ ID NO: 3902 - protein, 10 aa, Artificial Sequence
  Representative cyclic modulating agent based on cadherin-7 cell adhesion recognition sequence
DFIIDENTGK

SEQ ID NO: 3903 - protein, 11 aa, Artificial Sequence
  Representative cyclic modulating agent based on cadherin-7 cell adhesion recognition sequence
DIFIIDENTGK

SEQ ID NO: 3904 - protein, 6 aa, Artificial Sequence
  Representative cyclic modulating agent based on cadherin-7 cell adhesion recognition sequence
EDENTK

SEQ ID NO: 3905 - protein, 7 aa, Artificial Sequence
  Representative cyclic modulating agent based on cadherin-7 cell adhesion recognition sequence
EIDENTK

SEQ ID NO: 3906 - protein, 8 aa, Artificial Sequence
  Representative cyclic modulating agent based on cadherin-7 cell adhesion recognition sequence
EIIDENTK

SEQ ID NO: 3907 - protein, 9 aa, Artificial Sequence
  Representative cyclic modulating agent based on cadherin-7 cell adhesion recognition sequence
EFIIDENTK

SEQ ID NO: 3908 - protein, 10 aa, Artificial Sequence
  Representative cyclic modulating agent based on cadherin-7 cell adhesion recognition sequence
EIFIIDENTK

SEQ ID NO: 3909 - protein, 7 aa, Artificial Sequence
  Representative cyclic modulating agent based on cadherin-7 cell adhesion recognition sequence
EDENTGK

SEQ ID NO: 3910 - protein, 8 aa, Artificial Sequence
  Representative cyclic modulating agent based on cadherin-7 cell adhesion recognition sequence
EIDENTGK

SEQ ID NO: 3911 - protein, 9 aa, Artificial Sequence
  Representative cyclic modulating agent based on cadherin-7 cell adhesion recognition sequence
EIIDENTGK

SEQ ID NO: 3912 - protein, 10 aa, Artificial Sequence
  Representative cyclic modulating agent based on cadherin-7 cell adhesion recognition sequence
EFIIDENTGK

SEQ ID NO: 3913 - protein, 11 aa, Artificial Sequence
  Representative cyclic modulating agent based on cadherin-7 cell adhesion recognition sequence
EIFIIDENTGK

SEQ ID NO: 3914 - protein, 6 aa, Artificial Sequence
  Representative cyclic modulating agent based on cadherin-8 cell adhesion recognition sequence
ENDVTK

SEQ ID NO: 3915 - protein, 7 aa, Artificial Sequence
  Representative cyclic modulating agent based on cadherin-8 cell adhesion recognition sequence
EINDVTK

SEQ ID NO: 3916 - protein, 8 aa, Artificial Sequence
  Representative cyclic modulating agent based on cadherin-8 cell adhesion recognition sequence
EQINDVTK

SEQ ID NO: 3917 - protein, 9 aa, Artificial Sequence
  Representative cyclic modulating agent based on cadherin-8 cell adhesion recognition sequence
EFQINDVTK

SEQ ID NO: 3918 - protein, 10 aa, Artificial Sequence
  Representative cyclic modulating agent based on cadherin-8 cell adhesion recognition sequence
EIFQINDVTK

SEQ ID NO: 3919 - protein, 7 aa, Artificial Sequence
  Representative cyclic modulating agent based on cadherin-8 cell adhesion recognition sequence
ENDVTGK

SEQ ID NO: 3920 - protein, 8 aa, Artificial Sequence
  Representative cyclic modulating agent based on cadherin-8 cell adhesion recognition sequence
EINDVTGK

SEQ ID NO: 3921 - protein, 9 aa, Artificial Sequence
  Representative cyclic modulating agent based on cadherin-8 cell adhesion recognition sequence
EQINDVTGK

SEQ ID NO: 3922 - protein, 10 aa, Artificial Sequence
  Representative cyclic modulating agent based on cadherin-8 cell adhesion recognition sequence
EFQINDVTGK

SEQ ID NO: 3923 - protein, 11 aa, Artificial Sequence
  Representative cyclic modulating agent based on cadherin-8 cell adhesion recognition sequence
EIFQINDVTGK

SEQ ID NO: 3924 - protein, 6 aa, Artificial Sequence
  Representative cyclic modulating agent based on cadherin-8 cell adhesion recognition sequence
DNDVTK

SEQ ID NO: 3925 - protein, 7 aa, Artificial Sequence
  Representative cyclic modulating agent based on cadherin-8 cell adhesion recognition sequence
DINDVTK

SEQ ID NO: 3926 - protein, 8 aa, Artificial Sequence
  Representative cyclic modulating agent based on cadherin-8 cell adhesion recognition sequence
DQINDVTK

SEQ ID NO: 3927 - protein, 9 aa, Artificial Sequence
  Representative cyclic modulating agent based on cadherin-8 cell adhesion recognition sequence
DFQINDVTK

SEQ ID NO: 3928 - protein, 10 aa, Artificial Sequence
  Representative cyclic modulating agent based on cadherin-8 cell adhesion recognition sequence
DIFQINDVTK

SEQ ID NO: 3929 - protein, 7 aa, Artificial Sequence
  Representative cyclic modulating agent based on cadherin-8 cell adhesion recognition sequence
DNDVTGK

SEQ ID NO: 3930 - protein, 8 aa, Artificial Sequence
  Representative cyclic modulating agent based on cadherin-8 cell adhesion recognition sequence
DINDVTGK

SEQ ID NO: 3931 - protein, 9 aa, Artificial Sequence
  Representative cyclic modulating agent based on cadherin-8 cell adhesion recognition sequence
DQINDVTGK

SEQ ID NO: 3932 - protein, 10 aa, Artificial Sequence
  Representative cyclic modulating agent based on cadherin-8 cell adhesion recognition sequence
DFQINDVTGK

SEQ ID NO: 3933 - protein, 11 aa, Artificial Sequence
  Representative cyclic modulating agent based on cadherin-8 cell adhesion recognition sequence
DIFQINDVTGK

SEQ ID NO: 3934 - protein, 8 aa, Artificial Sequence
  Representative cyclic modulating agent based on cadherin-12 cell adhesion recognition sequence
DTIDETTK

SEQ ID NO: 3935 - protein, 9 aa, Artificial Sequence
  Representative cyclic modulating agent based on cadherin-12 cell adhesion recognition sequence
DFTIDETTK

SEQ ID NO: 3936 - protein, 10 aa, Artificial Sequence
  Representative cyclic modulating agent based on cadherin-12 cell adhesion recognition sequence
DVFTIDETTK

SEQ ID NO: 3937 - protein, 7 aa, Artificial Sequence
  Representative cyclic modulating agent based on cadherin-12 cell adhesion recognition sequence
DDETTGK

SEQ ID NO: 3938 - protein, 8 aa, Artificial Sequence
  Representative cyclic modulating agent based on cadherin-12 cell adhesion recognition sequence
DIDETTGK

SEQ ID NO: 3939 - protein, 9 aa, Artificial Sequence
  Representative cyclic modulating agent based on cadherin-12 cell adhesion recognition sequence
DTIDETTGK

SEQ ID NO: 3940 - protein, 10 aa, Artificial Sequence
  Representative cyclic modulating agent based on cadherin-12 cell adhesion recognition sequence
DFTIDETTGK

SEQ ID NO: 3941 - protein, 11 aa, Artificial Sequence
  Representative cyclic modulating agent based on cadherin-12 cell adhesion recognition sequence
DVFTIDETTGK

SEQ ID NO: 3942 - protein, 6 aa, Artificial Sequence
  Representative cyclic modulating agent based on cadherin-12 cell adhesion recognition sequence
EDETTK

SEQ ID NO: 3943 - protein, 7 aa, Artificial Sequence
  Representative cyclic modulating agent based on cadherin-12 cell adhesion recognition sequence
EIDETTK

SEQ ID NO: 3944 - protein, 8 aa, Artificial Sequence
  Representative cyclic modulating agent based on cadherin-12 cell adhesion recognition sequence
ETIDETTK

SEQ ID NO: 3945 - protein, 9 aa, Artificial Sequence
  Representative cyclic modulating agent based on cadherin-12 cell adhesion recognition sequence
EFTIDETTK

SEQ ID NO: 3946 - protein, 10 aa, Artificial Sequence
  Representative cyclic modulating agent based on cadherin-12 cell adhesion recognition sequence
DVFTIDETTK

SEQ ID NO: 3947 - protein, 7 aa, Artificial Sequence
  Representative cyclic modulating agent based on cadherin-12 cell adhesion recognition sequence
EDETTGK

SEQ ID NO: 3948 - protein, 8 aa, Artificial Sequence
  Representative cyclic modulating agent based on cadherin-12 cell adhesion recognition sequence
EIDETTGK

SEQ ID NO: 3949 - protein, 9 aa, Artificial Sequence
  Representative cyclic modulating agent based on cadherin-12 cell adhesion recognition sequence
ETIDETTGK

SEQ ID NO: 3950 - protein, 10 aa, Artificial Sequence
  Representative cyclic modulating agent based on cadherin-12 cell adhesion recognition sequence
EFTIDETTGK

SEQ ID NO: 3951 - protein, 11 aa, Artificial Sequence
  Representative cyclic modulating agent based on cadherin-12 cell adhesion recognition sequence
EVFTIDETTGK

SEQ ID NO: 3952 - protein, 7 aa, Artificial Sequence
  Representative cyclic modulating agent based on cadherin-14 cell adhesion recognition sequence
EIDDTTK

SEQ ID NO: 3953 - protein, 8 aa, Artificial Sequence
  Representative cyclic modulating agent based on cadherin-14 cell adhesion recognition sequence
EIIDDTTK

SEQ ID NO: 3954 - protein, 9 aa, Artificial Sequence
  Representative cyclic modulating agent based on cadherin-14 cell adhesion recognition sequence
EFIIDDTTK

SEQ ID NO: 3955 - protein, 10 aa, Artificial Sequence
  Representative cyclic modulating agent based on cadherin-14 cell adhesion recognition sequence
EIFIIDDTTK

SEQ ID NO: 3956 - protein, 7 aa, Artificial Sequence
  Representative cyclic modulating agent based on cadherin-14 cell adhesion recognition sequence
EDDTTGK

SEQ ID NO: 3957 - protein, 8 aa, Artificial Sequence
  Representative cyclic modulating agent based on cadherin-14 cell adhesion recognition sequence
EIDDTTGK

SEQ ID NO: 3958 - protein, 9 aa, Artificial Sequence
  Representative cyclic modulating agent based on cadherin-14 cell adhesion recognition sequence
EIIDDTTGK

SEQ ID NO: 3959 - protein, 10 aa, Artificial Sequence
  Representative cyclic modulating agent based on cadherin-14 cell adhesion recognition sequence
EFIIDDTTGK

SEQ ID NO: 3960 - protein, 11 aa, Artificial Sequence
  Representative cyclic modulating agent based on cadherin-14 cell adhesion recognition sequence
EIFIIDDTTGK

SEQ ID NO: 3961 - protein, 6 aa, Artificial Sequence
  Representative cyclic modulating agent based on cadherin-14 cell adhesion recognition sequence
DDDTTK

SEQ ID NO: 3962 - protein, 7 aa, Artificial Sequence
  Representative cyclic modulating agent based on cadherin-14 cell adhesion recognition sequence
DIDDTTK

SEQ ID NO: 3963 - protein, 9 aa, Artificial Sequence
  Representative cyclic modulating agent based on cadherin-14 cell adhesion recognition sequence
DFIIDDTTK

SEQ ID NO: 3964 - protein, 10 aa, Artificial Sequence
  Representative cyclic modulating agent based on cadherin-14 cell adhesion recognition sequence
DIFIIDDTTK

SEQ ID NO: 3965 - protein, 7 aa, Artificial Sequence
  Representative cyclic modulating agent based on cadherin-14 cell adhesion recognition sequence
DDDTTGK

SEQ ID NO: 3966 - protein, 8 aa, Artificial Sequence
  Representative cyclic modulating agent based on cadherin-14 cell adhesion recognition sequence
DIDDTTGK

SEQ ID NO: 3967 - protein, 9 aa, Artificial Sequence
  Representative cyclic modulating agent based on cadherin-14 cell adhesion recognition sequence
DIIDDTTGK

SEQ ID NO: 3968 - protein, 10 aa, Artificial Sequence
  Representative cyclic modulating agent based on cadherin-14 cell adhesion recognition sequence
DFIIDDTTGK

SEQ ID NO: 3969 - protein, 11 aa, Artificial Sequence
  Representative cyclic modulating agent based on cadherin-14 cell adhesion recognition sequence
DIFIIDDTTGK

SEQ ID NO: 3970 - protein, 6 aa, Artificial Sequence
  Representative cyclic modulating agent based on cadherin-14 cell adhesion recognition sequence
CDPKTC

SEQ ID NO: 3971 - protein, 7 aa, Artificial Sequence
  Representative cyclic modulating agent based on cadherin-14 cell adhesion recognition sequence
CDPKTGC

SEQ ID NO: 3972 - protein, 6 aa, Artificial Sequence
  Representative cyclic modulating agent based on cadherin-14 cell adhesion recognition sequence
CIDANC

SEQ ID NO: 3973 - protein, 7 aa, Artificial Sequence
  Representative cyclic modulating agent based on cadherin-14 cell adhesion recognition sequence
CNIDANC

SEQ ID NO: 3974 - protein, 8 aa, Artificial Sequence
  Representative cyclic modulating agent based on cadherin-14 cell adhesion recognition sequence
CFNIDANC

SEQ ID NO: 3975 - protein, 6 aa, Artificial Sequence
  Representative cyclic modulating agent based on cadherin-14 cell adhesion recognition sequence
EIDANK

SEQ ID NO: 3976 - protein, 7 aa, Artificial Sequence
  Representative cyclic modulating agent based on cadherin-14 cell adhesion recognition sequence
ENIDANK

SEQ ID NO: 3977 - protein, 8 aa, Artificial Sequence
  Representative cyclic modulating agent based on cadherin-14 cell adhesion recognition sequence
EFNIDANK

SEQ ID NO: 3978 - protein, 5 aa, Artificial Sequence
  Representative cyclic modulating agent based on cadherin-14 cell adhesion recognition sequence
KDPKD

SEQ ID NO: 3979 - protein, 6 aa, Artificial Sequence
  Representative cyclic modulating agent based on cadherin-14 cell adhesion recognition sequence
KDPKTD

SEQ ID NO: 3980 - protein, 7 aa, Artificial Sequence
  Representative cyclic modulating agent based on cadherin-14 cell adhesion recognition sequence
KDPKTGD

SEQ ID NO: 3981 - protein, 5 aa, Artificial Sequence
  Representative cyclic modulating agent based on cadherin-14 cell adhesion recognition sequence
KDAND

SEQ ID NO: 3982 - protein, 6 aa, Artificial Sequence
  Representative cyclic modulating agent based on cadherin-14 cell adhesion recognition sequence
KIDAND

SEQ ID NO: 3983 - protein, 7 aa, Artificial Sequence
  Representative cyclic modulating agent based on cadherin-14 cell adhesion recognition sequence
KNIDAND

SEQ ID NO: 3984 - protein, 6 aa, Artificial Sequence
  Representative cyclic modulating agent based on cadherin-14 cell adhesion recognition sequence
DIDANK

SEQ ID NO: 3985 - protein, 7 aa, Artificial Sequence
  Representative cyclic modulating agent based on cadherin-14 cell adhesion recognition sequence
DNIDANK

SEQ ID NO: 3986 - protein, 8 aa, Artificial Sequence
  Representative cyclic modulating agent based on cadherin-14 cell adhesion recognition sequence
DFNIDANK

SEQ ID NO: 3987 - protein, 9 aa, Artificial Sequence
  Representative cyclic modulating agent based on cadherin-14 cell adhesion recognition sequence
DFNIDANTK

SEQ ID NO: 3988 - protein, 5 aa, Artificial Sequence
  Representative cyclic modulating agent based on cadherin-14 cell adhesion recognition sequence
KDPKE

SEQ ID NO: 3989 - protein, 6 aa, Artificial Sequence
  Representative cyclic modulating agent based on cadherin-14 cell adhesion recognition sequence
KDPKTE

SEQ ID NO: 3990 - protein, 7 aa, Artificial Sequence
  Representative cyclic modulating agent based on cadherin-14 cell adhesion recognition sequence
KDPKTGE

SEQ ID NO: 3991 - protein, 6 aa, Artificial Sequence
  Representative cyclic modulating agent based on cadherin-14 cell adhesion recognition sequence
KIDANE

SEQ ID NO: 3992 - protein, 7 aa, Artificial Sequence
  Representative cyclic modulating agent based on cadherin-14 cell adhesion recognition sequence
KNIDANE

SEQ ID NO: 3993 - protein, 8 aa, Artificial Sequence
  Representative cyclic modulating agent based on cadherin-14 cell adhesion recognition sequence
KFNIDANE

SEQ ID NO: 3994 - protein, 8 aa, Artificial Sequence
  Representative cyclic modulating agent based on cadherin-15 cell adhesion recognition sequence
DSIDKFTK

SEQ ID NO: 3995 - protein, 9 aa, Artificial Sequence
  Representative cyclic modulating agent based on cadherin-15 cell adhesion recognition sequence
DFSIDKFTK

SEQ ID NO: 3996 - protein, 10 aa, Artificial Sequence
  Representative cyclic modulating agent based on cadherin-15 cell adhesion recognition sequence
DVFSIDKFTK

SEQ ID NO: 3997 - protein, 6 aa, Artificial Sequence
  Representative cyclic modulating agent based on cadherin-15 cell adhesion recognition sequence
DDKTGK

SEQ ID NO: 3998 - protein, 8 aa, Artificial Sequence
  Representative cyclic modulating agent based on cadherin-15 cell adhesion recognition sequence
DIDKFTGK

SEQ ID NO: 3999 - protein, 9 aa, Artificial Sequence
  Representative cyclic modulating agent based on cadherin-15 cell adhesion recognition sequence
DSIDKFTGK

SEQ ID NO: 4000 - protein, 10 aa, Artificial Sequence
  Representative cyclic modulating agent based on cadherin-15 cell adhesion recognition sequence
DFSIDKFTGK

SEQ ID NO: 4001 - protein, 11 aa, Artificial Sequence
  Representative cyclic modulating agent based on cadherin-15 cell adhesion recognition sequence
DVFSIDKFTGK

SEQ ID NO: 4002 - protein, 6 aa, Artificial Sequence
  Representative cyclic modulating agent based on cadherin-15 cell adhesion recognition sequence
EDKFTK

SEQ ID NO: 4003 - protein, 7 aa, Artificial Sequence
  Representative cyclic modulating agent based on cadherin-15 cell adhesion recognition sequence
EIDKFTK

SEQ ID NO: 4004 - protein, 8 aa, Artificial Sequence
  Representative cyclic modulating agent based on cadherin-15 cell adhesion recognition sequence
ESIDKFTK

SEQ ID NO: 4005 - protein, 9 aa, Artificial Sequence
  Representative cyclic modulating agent based on cadherin-15 cell adhesion recognition sequence
EFSIDKFTK

SEQ ID NO: 4006 - protein, 10 aa, Artificial Sequence
  Representative cyclic modulating agent based on cadherin-15 cell adhesion recognition sequence
EVFSIDKFTK

SEQ ID NO: 4007 - protein, 7 aa, Artificial Sequence
  Representative cyclic modulating agent based on cadherin-15 cell adhesion recognition sequence
EDKFTGK

SEQ ID NO: 4008 - protein, 8 aa, Artificial Sequence
  Representative cyclic modulating agent based on cadherin-15 cell adhesion recognition sequence
EIDKFTGK

SEQ ID NO: 4009 - protein, 10 aa, Artificial Sequence
  Representative cyclic modulating agent based on cadherin-15 cell adhesion recognition sequence
EFSIDKFTGK

SEQ ID NO: 4010 - protein, 11 aa, Artificial Sequence
  Representative cyclic modulating agent based on cadherin-15 cell adhesion recognition sequence
EVFSIDKFTGK

SEQ ID NO: 4011 - protein, 6 aa, Artificial Sequence
  Representative cyclic modulating agent based on T-cadherin cell adhesion recognition sequence
DNENTK

SEQ ID NO: 4012 - protein, 7 aa, Artificial Sequence
  Representative cyclic modulating agent based on T-cadherin cell adhesion recognition sequence
DINENTK

SEQ ID NO: 4013 - protein, 8 aa, Artificial Sequence
  Representative cyclic modulating agent based on T-cadherin cell adhesion recognition sequence
DRINENTK

SEQ ID NO: 4014 - protein, 9 aa, Artificial Sequence
  Representative cyclic modulating agent based on T-cadherin cell adhesion recognition sequence
DFRINENTK

SEQ ID NO: 4015 - protein, 10 aa, Artificial Sequence
  Representative cyclic modulating agent based on T-cadherin cell adhesion recognition sequence
DIFRINENTK

SEQ ID NO: 4016 - protein, 7 aa, Artificial Sequence
  Representative cyclic modulating agent based on T-cadherin cell adhesion recognition sequence
DNENTGK

SEQ ID NO: 4017 - protein, 8 aa, Artificial Sequence
  Representative cyclic modulating agent based on T-cadherin cell adhesion recognition sequence
DINENTGK

SEQ ID NO: 4018 - protein, 9 aa, Artificial Sequence
  Representative cyclic modulating agent based on T-cadherin cell adhesion recognition sequence
DRINENTGK

SEQ ID NO: 4019 - protein, 10 aa, Artificial Sequence
  Representative cyclic modulating agent based on T-cadherin cell adhesion recognition sequence
DFRINENTGK

SEQ ID NO: 4020 - protein, 11 aa, Artificial Sequence
  Representative cyclic modulating agent based on T-cadherin cell adhesion recognition sequence
DIFRINENTGK

SEQ ID NO: 4021 - protein, 6 aa, Artificial Sequence
  Representative cyclic modulating agent based on T-cadherin cell adhesion recognition sequence
ENENTK

SEQ ID NO: 4022 - protein, 7 aa, Artificial Sequence
  Representative cyclic modulating agent based on T-cadherin cell adhesion recognition sequence
EINENTK

SEQ ID NO: 4023 - protein, 8 aa, Artificial Sequence
  Representative cyclic modulating agent based on T-cadherin cell adhesion recognition sequence
ERINENTK

SEQ ID NO: 4024 - protein, 9 aa, Artificial Sequence
  Representative cyclic modulating agent based on T-cadherin cell adhesion recognition sequence
EFRINENTK

SEQ ID NO: 4025 - protein, 10 aa, Artificial Sequence
  Representative cyclic modulating agent based on T-cadherin cell adhesion recognition sequence
EIFRINENTK

SEQ ID NO: 4026 - protein, 7 aa, Artificial Sequence
  Representative cyclic modulating agent based on T-cadherin cell adhesion recognition sequence
ENENTGK

SEQ ID NO: 4027 - protein, 8 aa, Artificial Sequence
  Representative cyclic modulating agent based on T-cadherin cell adhesion recognition sequence
EINENTGK

SEQ ID NO: 4028 - protein, 9 aa, Artificial Sequence
  Representative cyclic modulating agent based on T-cadherin cell adhesion recognition sequence
ERINENTGK

SEQ ID NO: 4029 - protein, 10 aa, Artificial Sequence
  Representative cyclic modulating agent based on T-cadherin cell adhesion recognition sequence
EFRINENTGK

SEQ ID NO: 4030 - protein, 11 aa, Artificial Sequence
  Representative cyclic modulating agent based on T-cadherin cell adhesion recognition sequence
EIFRINENTGK

SEQ ID NO: 4031 - protein, 6 aa, Artificial Sequence
  Representative cyclic modulating agent based on T-cadherin cell adhesion recognition sequence
VNENTG

SEQ ID NO: 4032 - protein, 7 aa, Artificial Sequence
  Representative cyclic modulating agent based on T-cadherin cell adhesion recognition sequence
RINENTG

SEQ ID NO: 4033 - protein, 6 aa, Artificial Sequence
  Representative cyclic modulating agent based on T-cadherin cell adhesion recognition sequence
FRINEN

SEQ ID NO: 4034 - protein, 7 aa, Artificial Sequence
  Representative cyclic modulating agent based on T-cadherin cell adhesion recognition sequence
FRINENT

SEQ ID NO: 4035 - protein, 8 aa, Artificial Sequence
  Representative cyclic modulating agent based on T-cadherin cell adhesion recognition sequence
FRINENTG

SEQ ID NO: 4036 - protein, 7 aa, Artificial Sequence
  Representative cyclic modulating agent based on T-cadherin cell adhesion recognition sequence
IFRINEN

SEQ ID NO: 4037 - protein, 8 aa, Artificial Sequence
  Representative cyclic modulating agent based on T-cadherin cell adhesion recognition sequence
IFRINENT

SEQ ID NO: 4038 - protein, 9 aa, Artificial Sequence
  Representative cyclic modulating agent based on T-cadherin cell adhesion recognition sequence
IFRINENTG

SEQ ID NO: 4039 - protein, 5 aa, Artificial Sequence
  Representative cyclic modulating agent based on PB-cadherin cell adhesion recognition sequence
CDELC

SEQ ID NO: 4040 - protein, 6 aa, Artificial Sequence
  Representative cyclic modulating agent based on PB-cadherin cell adhesion recognition sequence
CDELTC

SEQ ID NO: 4041 - protein, 7 aa, Artificial Sequence
  Representative cyclic modulating agent based on PB-cadherin cell adhesion recognition sequence
CDELTGC

SEQ ID NO: 4042 - protein, 6 aa, Artificial Sequence
  Representative cyclic modulating agent based on PB-cadherin cell adhesion recognition sequence
CIDELC

SEQ ID NO: 4043 - protein, 7 aa, Artificial Sequence
  Representative cyclic modulating agent based on PB-cadherin cell adhesion recognition sequence
CIDELTC

SEQ ID NO: 4044 - protein, 8 aa, Artificial Sequence
  Representative cyclic modulating agent based on PB-cadherin cell adhesion recognition sequence
CIDELTGC

SEQ ID NO: 4045 - protein, 5 aa, Artificial Sequence
  Representative cyclic modulating agent based on PB-cadherin cell adhesion recognition sequence
CDPKC

SEQ ID NO: 4046 - protein, 6 aa, Artificial Sequence
  Representative cyclic modulating agent based on PB-cadherin cell adhesion recognition sequence
CDPKTC

SEQ ID NO: 4047 - protein, 7 aa, Artificial Sequence
  Representative cyclic modulating agent based on PB-cadherin cell adhesion recognition sequence
CDPKTGC

SEQ ID NO: 4048 - protein, 6 aa, Artificial Sequence
  Representative cyclic modulating agent based on PB-cadherin cell adhesion recognition sequence
CVDPKC

SEQ ID NO: 4049 - protein, 7 aa, Artificial Sequence
  Representative cyclic modulating agent based on PB-cadherin cell adhesion recognition sequence
CVDPKTC

SEQ ID NO: 4050 - protein, 8 aa, Artificial Sequence
  Representative cyclic modulating agent based on PB-cadherin cell adhesion recognition sequence
CVDPKTGC

SEQ ID NO: 4051 - protein, 4 aa, Artificial Sequence
  Representative linear modulating agent based on OB-cadherin cell adhesion recognition sequence
IDDK

SEQ ID NO: 4052 - protein, 9 aa, Artificial Sequence
  Representative linear modulating agent based on cadherin-related neuronal recepotr cell adhesion recognition sequence
KFLINEKTG

What is claimed is:

1. A modulating agent comprising a cell adhesion recognition (CAR) amino acid sequence according to the formula Xaa-Phe-Xaa-Xaa-Xaa-Xaa-Xaa-Xaa-Gly    (SEQ ID NO: 3)

wherein Xaa at amino acid position 1 is any amino acid residue, Xaa at amino acid positions 3–7 are Arg-Val-Asp-Ala-Glu (SEQ ID NO: 116), respectively, and Xaa at amino acid position 8 is an amino acid that is selected from the group consisting of serine, threonine, and asparagine and wherein said modulating agent contains no more than 50 consecutive amino acid residues present within cadherin-5.

2. A modulating agent according to claim 1 wherein said modulating agent contains no more than 16 amino acid residues.

3. A modulating agent according to any one of claims 1–2 wherein the CAR sequence is present within a cyclic peptide.

4. A modulating agent according to claim 3 wherein said agent detectably enhances adhesion of cells that express cadherin-5.

5. A modulating agent according to claim 4 wherein the cells that express cadherin-5 are endothelial cells.

6. A modulating agent according to claim 3 wherein said agent inhibits adhesion of cells that express cadherin-5.

7. A modulating agent according to claim 6 wherein the cells that express cadherin-5 are endothelial cells.

8. A modulating agent according to claim 1 wherein the CAR includes a sequence selected from the group consisting of SEQ ID NO: 118, 121, 122, 123, 124, 125, 126, and 127.

9. A modulating agent according to claim 8 wherein the CAR sequence is present within a cyclic peptide.

10. A modulating agent according to claim 1 wherein the agent comprises SEQ ID NO: 127.

11. A modulating agent according to claim 1 linked to a drug.

12. A modulating agent according to claim 1 linked to a detectable marker.

13. A modulating agent according to claim 1 linked to a targeting agent.

14. A modulating agent according to claim 1 linked to a support material.

15. A modulating agent according to claim 14, wherein the support material is a polymeric matrix.

16. A modulating agent according to claim 14, wherein the support material is selected from the group consisting of plastic dishes, plastic tubes, sutures, membranes, ultra thin films, bioreactors, and microparticles.

17. A composition comprising a modulating agent according to claim 1 in combination with a pharmaceutically acceptable carrier.

18. A composition according to claim 17 further comprising a drug.

19. A composition according to claim 17 wherein the modulating agent is present within a sustained-release formulation.

20. A modulating agent comprising a cyclic peptide which comprises a sequence selected from the group consisting of SEQ ID NOS: 913, 915, 918–924, 927–929, 932–934, 938, 940, 943–949, 958, 960 963–969, and 973–981 and wherein said modulating agent contains no more than 50 consecutive amino acid residues present within cadherin-5.

* * * * *